US010150800B2

(12) United States Patent
Roschke et al.

(10) Patent No.: US 10,150,800 B2
(45) Date of Patent: Dec. 11, 2018

(54) EGFR-BINDING MODULAR RECOGNITION DOMAINS

(71) Applicant: Zyngenia, Inc., Gaithersburg, MD (US)

(72) Inventors: Viktor Roschke, Bethesda, MD (US); David Lafleur, Washington, DC (US); David M. Hilbert, Bethesda, MD (US); Peter Kiener, Potomac, MD (US)

(73) Assignee: Zyngenia, Inc., Washington, DC (US)

( * ) Notice: Subject to any disclaimer, the term of this patent is extended or adjusted under 35 U.S.C. 154(b) by 128 days.

(21) Appl. No.: 14/776,816

(22) PCT Filed: Mar. 14, 2014

(86) PCT No.: PCT/US2014/029077
§ 371 (c)(1),
(2) Date: Sep. 15, 2015

(87) PCT Pub. No.: WO2014/144600
PCT Pub. Date: Sep. 18, 2014

(65) Prior Publication Data
US 2016/0046678 A1 Feb. 18, 2016

Related U.S. Application Data

(60) Provisional application No. 61/802,343, filed on Mar. 15, 2013.

(51) Int. Cl.
| | | |
|---|---|---|
| *A61K 38/10* | (2006.01) | |
| *A61K 39/395* | (2006.01) | |
| *C07K 7/08* | (2006.01) | |
| *C07K 16/28* | (2006.01) | |
| *C07K 19/00* | (2006.01) | |
| *C07K 14/435* | (2006.01) | |
| *C07K 16/24* | (2006.01) | |
| *C07K 16/32* | (2006.01) | |
| *A61K 45/06* | (2006.01) | |
| *C07K 16/18* | (2006.01) | |
| *C07K 16/40* | (2006.01) | |
| *C12N 9/00* | (2006.01) | |
| *A61K 39/00* | (2006.01) | |
| *A61K 38/00* | (2006.01) | |

(52) U.S. Cl.
CPC ............ *C07K 14/435* (2013.01); *A61K 45/06* (2013.01); *C07K 7/08* (2013.01); *C07K 16/18* (2013.01); *C07K 16/24* (2013.01); *C07K 16/28* (2013.01); *C07K 16/2848* (2013.01); *C07K 16/2863* (2013.01); *C07K 16/32* (2013.01); *C07K 16/40* (2013.01); *C12N 9/0002* (2013.01); *A61K 38/00* (2013.01); *A61K 2039/505* (2013.01); *C07K 2317/31* (2013.01); *C07K 2317/35* (2013.01); *C07K 2317/76* (2013.01); *C07K 2319/00* (2013.01); *Y02A 50/412* (2018.01)

(58) Field of Classification Search
None
See application file for complete search history.

(56) References Cited

U.S. PATENT DOCUMENTS

| | | |
|---|---|---|
| 4,599,304 A | 7/1986 | Lanier et al. |
| 5,141,736 A | 8/1992 | Iwasa et al. |
| 5,196,193 A | 3/1993 | Carroll |
| 5,637,481 A | 6/1997 | Ledbetter et al. |
| 5,677,171 A | 10/1997 | Hudziak et al. |
| 5,720,954 A | 2/1998 | Hudziak et al. |
| 5,725,856 A | 3/1998 | Hudziak et al. |
| 5,770,195 A | 6/1998 | Hudziak et al. |
| 5,772,997 A | 6/1998 | Hudziak et al. |
| 5,821,337 A | 10/1998 | Carter et al. |
| 5,844,094 A | 12/1998 | Hudson et al. |
| 5,977,322 A | 2/1999 | Marks et al. |
| 5,877,289 A | 3/1999 | Thorpe et al. |
| 6,054,561 A | 4/2000 | Ring |
| 6,103,889 A | 8/2000 | Whitlow et al. |
| 6,132,992 A | 10/2000 | Ledbetter et al. |
| 6,165,464 A | 12/2000 | Hudziak et al. |
| 6,166,185 A | 12/2000 | Davis et al. |
| 6,194,177 B1 | 2/2001 | Campbell et al. |
| 6,235,883 B1 | 5/2001 | Jacobovits et al. |
| 6,267,958 B1 | 7/2001 | Andya et al. |
| 6,268,488 B1 | 7/2001 | Barbas, III et al. |
| 6,339,142 B1 | 1/2002 | Basey et al. |
| 6,387,371 B1 | 5/2002 | Hudziak et al. |
| 6,399,063 B1 | 6/2002 | Hudziak et al. |
| 6,413,932 B1 | 7/2002 | Cerretti et al. |
| 6,417,168 B1 | 7/2002 | Greene et al. |

(Continued)

FOREIGN PATENT DOCUMENTS

| | | |
|---|---|---|
| EP | 1 591 527 A1 | 11/2005 |
| EP | 1 600 459 A2 | 11/2005 |

(Continued)

OTHER PUBLICATIONS

Abraham, S., et al., "Synthesis of the next-generation therapeutic antibodies that combine cel targeting and antibody-catalyzed prodrug activation," PNAS USA 104(13):5584-5589, National Academy of Sciences, United States (2007).

(Continued)

*Primary Examiner* — Christine J Saoud

(74) *Attorney, Agent, or Firm* — Sterne, Kessler, Goldstein & Fox P.L.L.C.

(57) ABSTRACT

EGFR-binding modular recognition domains (MRDs) and complexes containing such MRDs linked to antibodies are described. The use of such MRDs and complexes are also described.

13 Claims, 30 Drawing Sheets

Specification includes a Sequence Listing.

(56) References Cited

U.S. PATENT DOCUMENTS

| | | |
|---|---|---|
| 6,458,356 B1 | 10/2002 | Arakawa et al. |
| 6,512,096 B2 | 1/2003 | Weiner et al. |
| 6,515,110 B1 | 2/2003 | Whitlow et al. |
| 6,521,424 B2 | 2/2003 | Cerretti et al. |
| 6,627,196 B1 | 9/2003 | Baughman et al. |
| 6,719,971 B1 | 4/2004 | Carter et al. |
| 6,800,738 B1 | 10/2004 | Carter et al. |
| 6,818,213 B1 | 11/2004 | Thorpe et al. |
| 6,821,515 B1 | 11/2004 | Cleland et al. |
| 6,884,879 B1 | 4/2005 | Baca et al. |
| 7,063,840 B2 | 6/2006 | Davis et al. |
| 7,067,475 B2 | 6/2006 | Cerretti et al. |
| 7,074,404 B2 | 7/2006 | Basey et al. |
| 7,101,580 B2 | 9/2006 | Metzger |
| 7,112,317 B2 | 9/2006 | Thorpe et al. |
| 7,125,541 B2 | 10/2006 | Thorpe et al. |
| 7,138,370 B2 | 11/2006 | Oliner et al. |
| 7,148,321 B2 | 12/2006 | Gillies et al. |
| 7,183,076 B2 | 2/2007 | Arathoon et al. |
| 7,189,830 B2 | 3/2007 | Gillies et al. |
| 7,205,275 B2 | 4/2007 | Oliner et al. |
| 7,211,252 B2 | 5/2007 | Mundy et al. |
| 7,226,592 B2 | 6/2007 | Kreysch |
| 7,365,054 B2 | 4/2008 | Lode et al. |
| 7,371,379 B2 | 5/2008 | Baughman et al. |
| 7,449,184 B2 | 11/2008 | Allison et al. |
| 7,456,016 B2 | 11/2008 | Young et al. |
| 7,462,352 B2 | 12/2008 | Hansen et al. |
| 7,485,302 B2 | 2/2009 | Adams et al. |
| 7,521,053 B2 | 4/2009 | Oliner |
| 7,537,931 B2 | 5/2009 | Adams et al. |
| 7,541,440 B2 | 6/2009 | Goldenberg et al. |
| 7,612,181 B2 | 11/2009 | Wu et al. |
| 7,625,558 B2 | 12/2009 | Greene et al. |
| 7,638,124 B2 | 12/2009 | Reiter et al. |
| 7,645,861 B2 | 1/2010 | Gegg et al. |
| 7,655,764 B2 | 2/2010 | Gegg et al. |
| 7,655,765 B2 | 2/2010 | Gegg et al. |
| 7,662,931 B2 | 2/2010 | Gegg et al. |
| 7,666,832 B2 | 2/2010 | Oliner et al. |
| 7,666,839 B2 | 2/2010 | Oliner et al. |
| 7,682,609 B2 | 3/2010 | Andya et al. |
| 7,723,499 B2 | 5/2010 | Oliner et al. |
| 7,736,652 B2 | 6/2010 | Penichet et al. |
| 7,741,446 B2 | 6/2010 | Pardridge et al. |
| 7,749,501 B2 | 7/2010 | Gelfand |
| 7,750,127 B2 | 7/2010 | Gegg et al. |
| 7,750,128 B2 | 7/2010 | Gegg et al. |
| 7,786,267 B2 | 8/2010 | Zurawski et al. |
| 7,790,674 B2 | 9/2010 | Oliner et al. |
| 7,862,817 B2 | 1/2011 | Adams et al. |
| 7,951,369 B2 | 5/2011 | Goldenberg et al. |
| 7,973,140 B2 | 7/2011 | Green et al. |
| 7,981,418 B2 | 7/2011 | Amler et al. |
| 7,993,834 B2 | 8/2011 | Mass |
| 8,008,453 B2 | 8/2011 | Gegg et al. |
| 8,454,960 B2 | 6/2013 | Barbas, III |
| 8,557,242 B2 | 10/2013 | Barbas, III |
| 8,557,243 B2 | 10/2013 | Barbas, III |
| 9,676,833 B2 | 6/2017 | Roschke et al. |
| 2003/0130496 A1 | 7/2003 | Winter et al. |
| 2003/0229023 A1 | 12/2003 | Oliner et al. |
| 2003/0236193 A1 | 12/2003 | Oliner et al. |
| 2004/0001827 A1 | 1/2004 | Dennis |
| 2004/0052785 A1 | 3/2004 | Goodman et al. |
| 2004/0057969 A1 | 3/2004 | Smith et al. |
| 2004/0106161 A1 | 6/2004 | Bossenmaier et al. |
| 2005/0136044 A1 | 6/2005 | Watkins et al. |
| 2005/0287153 A1 | 12/2005 | Dennis |
| 2006/0106203 A1 | 5/2006 | Winter et al. |
| 2006/0128944 A1 | 6/2006 | Botti et al. |
| 2006/0140936 A1 | 6/2006 | Goldenberg et al. |
| 2006/0222653 A1 | 10/2006 | Abel et al. |
| 2006/0269540 A1 | 11/2006 | Robert et al. |
| 2007/0031402 A1 | 2/2007 | Zhang et al. |
| 2007/0086998 A1 | 4/2007 | Nagy |
| 2007/0166753 A1 | 7/2007 | Mass |
| 2007/0196274 A1 | 8/2007 | Sun |
| 2007/0202041 A1 | 8/2007 | Young et al. |
| 2007/0248994 A1 | 10/2007 | Su |
| 2007/0254316 A1 | 11/2007 | Rodriguez et al. |
| 2008/0233130 A1 | 9/2008 | Tomlinson et al. |
| 2008/0241145 A1 | 10/2008 | Goldenberg et al. |
| 2008/0299120 A1 | 12/2008 | Miller et al. |
| 2009/0054323 A1 | 2/2009 | Oliner et al. |
| 2009/0087432 A1 | 4/2009 | Sliwkowski |
| 2009/0148905 A1 | 6/2009 | Ashman et al. |
| 2009/0162359 A1 | 6/2009 | Klein et al. |
| 2009/0181022 A1 | 7/2009 | Nielsen et al. |
| 2009/0191212 A1 | 7/2009 | Oliner et al. |
| 2009/0226447 A1 | 9/2009 | Boone et al. |
| 2009/0226466 A1 | 9/2009 | Fong et al. |
| 2009/0246206 A1 | 10/2009 | Nielsen et al. |
| 2009/0298195 A1 | 12/2009 | Rüker et al. |
| 2009/0304694 A1 | 12/2009 | Oliner et al. |
| 2010/0016556 A1 | 1/2010 | Carter et al. |
| 2010/0021379 A1 | 1/2010 | Lam et al. |
| 2010/0021473 A1 | 1/2010 | De Angelis et al. |
| 2010/0047239 A1 | 2/2010 | Wu et al. |
| 2010/0048877 A1 | 2/2010 | Ruker et al. |
| 2010/0056439 A1 | 3/2010 | Roland et al. |
| 2010/0104588 A1 | 4/2010 | Dennis |
| 2010/0111967 A1 | 5/2010 | Baehner et al. |
| 2010/0158926 A1 | 6/2010 | Cartilage et al. |
| 2010/0159587 A1 | 6/2010 | Brinkmann et al. |
| 2010/0166695 A1 | 7/2010 | Bundle et al. |
| 2010/0166746 A1 | 7/2010 | Chowdhury et al. |
| 2010/0178298 A1 | 7/2010 | Lindhofer |
| 2010/0233173 A1 | 9/2010 | Wu et al. |
| 2010/0286060 A1 | 11/2010 | Oliner et al. |
| 2010/0297103 A1 | 11/2010 | Murakami |
| 2010/0322934 A1 | 12/2010 | Imhof-Jung et al. |
| 2010/0330115 A1 | 12/2010 | Zurawski et al. |
| 2011/0020332 A1 | 1/2011 | Greene et al. |
| 2011/0027286 A1 | 2/2011 | Thurston et al. |
| 2011/0044998 A1 | 2/2011 | Bedian et al. |
| 2011/0046355 A1 | 2/2011 | Himmler et al. |
| 2011/0076723 A1 | 3/2011 | Min et al. |
| 2011/0097300 A1 | 4/2011 | Van Slyke et al. |
| 2011/0097321 A1 | 4/2011 | Blakey et al. |
| 2011/0110851 A1 | 5/2011 | Chang et al. |
| 2011/0129464 A1 | 6/2011 | Adams et al. |
| 2011/0150895 A1 | 6/2011 | Ryu et al. |
| 2011/0158978 A1 | 6/2011 | Kirchner et al. |
| 2011/0189206 A1 | 8/2011 | Barbas, III |
| 2012/0020966 A1 | 1/2012 | Barbas, III |
| 2012/0020967 A1 | 1/2012 | Barbas, III |
| 2012/0034211 A1 | 2/2012 | Barbas, III |
| 2012/0058114 A1 | 3/2012 | Barbas, III |
| 2012/0100166 A1 | 4/2012 | Roschke et al. |
| 2013/0303733 A1 | 11/2013 | Barbas |
| 2014/0065142 A1 | 3/2014 | Roschke et al. |
| 2014/0127200 A1 | 5/2014 | Barbas, III |
| 2015/0210765 A1 | 7/2015 | Roschke et al. |
| 2016/0046678 A1 | 2/2016 | Roschke et al. |
| 2016/0159863 A1 | 6/2016 | Barbas, III |
| 2017/0298106 A1 | 10/2017 | Roschke et al. |

FOREIGN PATENT DOCUMENTS

| | | |
|---|---|---|
| EP | 1 517 921 B1 | 6/2006 |
| EP | 1 752 471 B9 | 11/2008 |
| EP | 2 070 944 A1 | 6/2009 |
| EP | 1 189 641 B1 | 7/2009 |
| EP | 1 210 115 B1 | 8/2009 |
| EP | 1 434 791 B1 | 10/2009 |
| EP | 2 110 138 A1 | 10/2009 |
| EP | 2 116 262 A2 | 11/2009 |
| EP | 2 272 869 A2 | 1/2011 |
| EP | 2 275 119 A1 | 1/2011 |
| EP | 2 284 194 A1 | 2/2011 |
| EP | 2 311 849 A1 | 4/2011 |
| EP | 2 316 845 A1 | 5/2011 |
| EP | 2 336 180 A1 | 6/2011 |

(56) References Cited

FOREIGN PATENT DOCUMENTS

| | | |
|---|---|---|
| JP | 2003-531588 | 10/2003 |
| JP | 2004-525630 | 8/2004 |
| JP | 2005-520853 | 7/2005 |
| WO | WO 95/24220 A1 | 9/1995 |
| WO | WO 96/11269 A2 | 4/1996 |
| WO | WO 97/20858 A1 | 6/1997 |
| WO | WO 98/50431 A2 | 11/1998 |
| WO | WO 01/81377 A2 | 11/2001 |
| WO | WO 02/079377 A2 | 10/2002 |
| WO | WO 03/016330 A2 | 2/2003 |
| WO | WO 03/027246 A2 | 4/2003 |
| WO | WO 2004/032857 A2 | 4/2004 |
| WO | WO 2004/032961 A1 | 4/2004 |
| WO | WO 2004/092215 A2 | 10/2004 |
| WO | WO 2005/023859 A1 | 3/2005 |
| WO | WO 2005/070966 A2 | 8/2005 |
| WO | WO 2005/117973 A2 | 12/2005 |
| WO | WO 2006/020706 A2 | 2/2006 |
| WO | WO 2006/036834 A2 | 6/2006 |
| WO | WO 2006/063150 A2 | 6/2006 |
| WO | WO 2006/078307 A1 | 7/2006 |
| WO | WO 2006/091209 A2 | 8/2006 |
| WO | WO 2007/001457 A2 | 1/2007 |
| WO | WO 2007/016185 A2 | 2/2007 |
| WO | WO 2007/019232 A2 | 2/2007 |
| WO | WO 2007/024715 A2 | 3/2007 |
| WO | WO 2007/060192 A1 | 5/2007 |
| WO | WO 2007/066109 A1 | 6/2007 |
| WO | WO 2007/068895 A1 | 6/2007 |
| WO | WO 2007/075270 A2 | 7/2007 |
| WO | WO 2007/136892 A2 | 11/2007 |
| WO | WO 2008/003103 A2 | 1/2008 |
| WO | WO 2008/019290 A2 | 2/2008 |
| WO | WO 2008/088658 A2 | 7/2008 |
| WO | WO 2008/116293 A1 | 10/2008 |
| WO | WO 2008/132658 A2 | 11/2008 |
| WO | WO 2008/144029 A1 | 11/2008 |
| WO | WO 2009/088805 A2 | 7/2009 |
| WO | WO 2009/097325 A1 | 8/2009 |
| WO | WO 2009/105269 A1 | 8/2009 |
| WO | WO 2009/132876 A1 | 11/2009 |
| WO | WO 2009/158432 A2 | 12/2009 |
| WO | WO 2010/010551 A2 | 1/2010 |
| WO | WO 2010/040508 A1 | 4/2010 |
| WO | WO 2010/066836 A2 | 6/2010 |
| WO | WO 2010/108153 A2 | 9/2010 |
| WO | WO 2011/014469 A1 | 2/2011 |
| WO | WO 2012/009705 A1 | 1/2012 |
| WO | WO 2012/109624 A2 | 8/2012 |
| WO | WO 2012/162561 A2 | 11/2012 |
| WO | WO 2014/144600 A2 | 9/2014 |

OTHER PUBLICATIONS

Asano, R., et al., "Highly Effective Recombinant Format of a Humanized IgG-like Bispecific Antibody for Cancer Immunotherapy with Retargeting of Lymphocytes to Tumor Cells," *JBC* 282(38):27659-27665, The American Society for Biochemistry and Molecular Biology, Inc., United States (2007).

Bhagwat, S.S., "Kinase inhibitors for the treatment of inflammatory and autoimmune disorders," *Purinergic Signalling* 5(1):107-115, Springer, Netherlands (2009).

Connor, J.P., et al., "Ex vivo evaluation of anti-EpCAM immunocytokine huKS-IL2 in ovarian cancer," *J. Immunother.* 27(3):211-219, Lippincott Williams & Wilkins, United States (2004).

Corte-Real, S., et al., "Intrabodies targeting the Kaposi sarcoma-associated herpesvirus latency antigen inhibit persistence in lymphoma cells," *Blood* 106:3797-3802, American Society of Hematology, United States (2005).

Dela Cruz, J.S., et al., "Recombinant Anti-Human HER2/neu IgG3-(GM-CSF) Fusion Protein Retains Antigen Specificity and Cytokine Function and Demonstrates Antitumor Activity," *J. Immunol.* 165:5112-5121, The American Association of Immunologists, United States (2000).

Dennis, M.S., et al., "Albumin Binding as a General Strategy for Improving the Pharmacokinetics of Proteins," *JBC* 277(33):35035-35043, The American Society for Biochemistry and Molecular Biology, Inc., United States (2002).

Doppalapudi et al., "Chemically programmed antibodies: Endothelin receptor targeting CovX-Bodies(TM)," *Bioorganic & Medicinal Chemistry Letters* 17(2):501-506, Pergamon, Elsevier Science, Great Britain (2007).

Grzesik, W.J., et al., "Synthetic integrin-binding peptides promote adhesion and proliferation of human periodontal ligament cells in vitro," *J. Dent. Res.* 77(8):1606-1612, International & American Associations for Dental Research, United States (1998).

Helguera, G., et al., "Vaccination with novel combinations of anti-HER2/neu cytokines fusion proteins and soluble protein antigen elicits a protective immune response against HER2/neu expressing tumors," *Vaccine* 24:304-316, Elsevier Ltd., England (2005).

Huang, H., et al., "Angiopoietin-2 antagonistic CovX-BodyTM inhibits tumor growth and reduces microvessel density" *Proceedings of the Annual Meeting of the American Association for Cancer Research* 48:509, American Association for Cancer Research, United States (2007).

International Preliminary Report on Patentability, including the Written Opinion of the International Searching Authority, for International Application No. PCT/US2012/039469, The International Bureau of WIPO, Geneva, Switzerland, dated Nov. 26, 2013, 7 pages.

International Search Report for International Application No. PCT/US2012/039469, European Patent Office, Rijswijk, Netherlands, dated Jan. 15, 2013, 5 pages.

Kutty, G., et al., "Identification of a new member of transforming growth factor-beta superfamily in *Drosophila*: the first invertebrate activin gene," *Biochem. Biophys. Res. Commun.* 246(3):644-649, Elsevier B.V., Netherlands (1998).

Landon, L.A. and Deutscher, S.L., "Combinatorial discovery of tumor targeting peptides using phage display," *J. Cell. Biochem.* 90(3):509-517, Wiley-Liss, United States (2003).

Li, L-S., et al., "Chemical Adaptor Immunotherapy: Design, Synthesis, and Evaluation of Novel Integrin-Targeting Devices," *J. Med. Chem.* 47:5630-5640, American Chemical Society, United States (2004).

Luettich K. and Schmidt, C. "TGF$\beta_1$ activates c-Jun and Erk1 via $\alpha_v\beta_6$ integrin," *Molecular Cancer* 2:33, BioMed Central, England, 10 pages (2003).

Niu, G. and Carter B.W., "Human Epidermal Growth Factor Receptor 2 Regulates Angiopoietin-2 Expression in Breast Cancer via AKT and Mitogen-Activated Protein Kinase Pathways," *Cancer Res.* 67:1487-1493, American Association for Cancer Research, United States (2007).

Riemer, A.B.., et al., "Matching of trastuzumab (Herceptin®) epitope mimics onto the surface of Her-2/neu—a new method of epitope definition," *Mol. Immunol.* 42(9):1121-1124, Elsevier B.V., Netherlands (2005).

Ruoslahti, E., "Integrins," *J. Clin. Invest.* 87:1-5, The American Society for Clinical investigation, Inc., United States (1991).

Schraa, A.J., et al., "RGD-modified anti-CD3 antibodies redirect cytolytic capacity of cytotoxic T lymphocytes toward $\alpha_v\beta_3$-expressing endothelial cells," *Int. J. Cancer* 112(2):279-285, Wiley-Liss, Inc., United States (2004).

Serini, G., et al., "Integrins and angiogenesis: A sticky business," *Exp. Cell Res.* 312(5):651-658, Academic Press, United States (2006).

Sinha, S.C., et al., "Preparation of integrin $\alpha(v)\beta(3)$-targeting Ab 38C2 constructs," *Nature Protocols* 2(2):449-456, Nature Publishing Group, England (2007).

Stancovski, I., et al., "Mechanistic aspects of the opposing effects of monoclonal antibodies to the ERBB2 receptor on tumor growth," *Proc. Natl. Acad. Sci. USA* 88:8691-8695, United States National Academy of Sciences, United States (1991).

Taipale, J. and Keski-Oja, J., "Growth factors in the extracellular matrix," *The FASEB Journal* 11:51-59, Federation of American Societies for Experimental Biology, United States (1997).

(56) References Cited

OTHER PUBLICATIONS

Yu, L., et al., "Interaction between Bevavizumab and Murine VEGF-A: A Reassessment," *Invest Ophthalmol Vis Sci.* 49(2):522-527, Association for Research in Vision and Ophthalmology, United States (2008).

Zhang, J., et al., "Targeting cancer with small molecule kinase inhibitors," *Nature Reviews Cancer* 9(1):28-39, Nature Publishing Group, England (2009).

Lafleur, D.W., et al., "Monoclonal antibody therapeutics with up to five specificities: functional enhancement through fusion of target-specific peptides," *MAbs* 5(2):208-218, Landes Bioscience, United States (2013).

Partial Supplementary European Search Report, Communication pursuant to Rule 164(1) EPC, for EP Application No. 14762732.7, Munich, Germany, dated Sep. 29, 2016, 8 pages.

Supplementary European Search Report for EP Application No. 14762732.7, Munich, Germany, dated Jan. 12, 2017, 12 pages.

International Preliminary Report on Patentability and Written Opinion for International Application No. PCT/US2014/029077, The International Bureau of WIPO Geneva, Switzerland, dated Sep. 15, 2015, 9 pages.

International Search Report for International Application No. PCT/US2014/029077, ISA/US, Commissioner for Patents, U.S. Patent and Trademark Office, dated Nov. 5, 2014, 5 pages.

El-Gazzar, A., et al., "Effects on Tumor Development and Metastatic Dissemination by the NKG2D Lymphocyte Receptor Expressed on Cancer Cells," *Oncogene* 33(41):4932-4940, Nature Publishing Group, England (Oct. 2014).

Muller, J., et al., "Targeting of Tumor Blood Vessels: A Phage-Displayed Tumor-Homing Peptide Specifically Binds to Matrix Metalloproteinase-2-Processed Collagen IV and Blocks Angiogenesis In Vivo," *Mol Canc Res.* 7(7):1078-1085, American Association for Cancer Research, United States (2009).

U.S. Appl. No. 15/589,585, inventors Roschke et al., filed May 8, 2017 (Not Published).

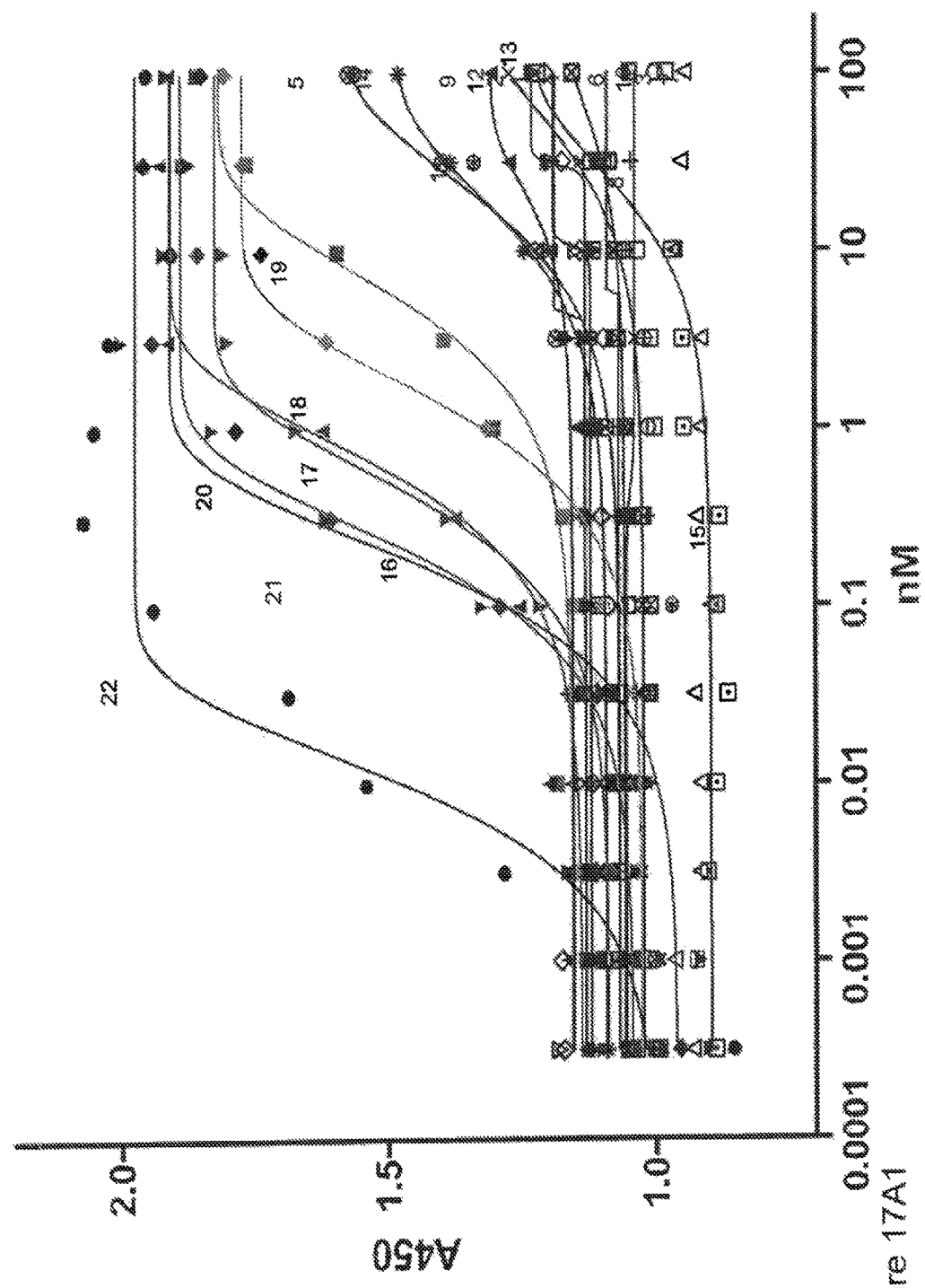
Figure 17A1

| | | | | | | | |
|---|---|---|---|---|---|---|---|
| 1 ▽ L17D MQD | 5 ⊗ L17D MED | 9 ▲ L17D MYD | 13 ◇ L17D MVD | 17 ▲ L17D MGD | 21 ▶ L17D MDD 5/7 | | |
| 2 ▶ L17D MPD | 6 ▣ L17D MID | 10 ○ L17D MFD | 14 ✱ L17D MHD | 18 ◆ L17D MSD | 22 ◆ 2xLm32 4/23 | | |
| 3 □ L17D MWD | 7 △ L17D MLD | 11 ⊗ L17D MFD* | 15 ⊡ L17D MRD | 19 ■ L17D MTD | | | |
| 4 ◈ L17D MMD | 8 + L17D MKD | 12 × L17D MAD | 16 ▶ L17D MND | 20 ◆ Lm32 KtoS | | | |

FIG. 17A2

| Protein | Clone ID | MRD Sequence | EC50, nM |
|---|---|---|---|
| L1-7D MDD | 2C12 | PGKGGGSMGAQTNFMPM*MDD*DEQRLYEQFILQQGLE (SEQ ID NO:114) | 0.153 |
| L1-7D MQD | 1A12 | PGKGGGSMGAQTNFMPM*QDD*DEQRLYEQFILQQGLE (SEQ ID NO:115) | >100 |
| L1-7D MVD | 2A1 | PGKGGGSMGAQTNFMPM*VDD*DEQRLYEQFILQQGLE (SEQ ID NO:116) | >100 |
| L1-7D MHD | 3C3 | PGKGGGSMGAQTNFMPM*HDD*DEQRLYEQFILQQGLE (SEQ ID NO:117) | 17.00 |
| L1-7D MND | 4H4 | PGKGGGSMGAQTNFMPM*NDD*DEQRLYEQFILQQGLE (SEQ ID NO:118) | 0.411 |
| L1-7D MKD | 5A8 | PGKGGGSMGAQTNFMPM*KDD*DEQRLYEQFILQQGLE (SEQ ID NO:119) | >100 |
| L1-7D MAD | 6A3 | PGKGGGSMGAQTNFMI*MAD*DEQRLYEQFILQQGLE (SEQ ID NO:120) | >100 |
| L1-7D MSD | 7B2 | PGKGGGSMGAQTNFMPM*MSD*DEQRLYEQFILQQGLE (SEQ ID NO:121) | 1.380 |
| L1-7D MRD | 8B12 | PGKGGGSMGAQTNFMPM*MRD*DEQRLYEQFILQQGLE (SEQ ID NO:122) | >100 |
| L1-7D MGD | 9C7 | PGKGGGSMGAQTNFMPM*MGD*DEQRLYEQFILQQGLE (SEQ ID NO:123) | 0.600 |
| L1-7D MTD | 10B12 | PGKGGGSMGAQTNFMPM*MTD*DEQRLYEQFILQQGLE (SEQ ID NO:124) | 7.340 |
| L1-7D MYD | 11B10 | PGKGGGSMGAQTNFMPM*MYD*DEQRLYEQFILQQGLE (SEQ ID NO:125) | >100 |
| L1-7D MPD | 12C12 | PGKGGGSMGAQTNFMPM*MPD*DEQRLYEQFILQQGLE (SEQ ID NO:126) | >100 |
| L1-7D MID | 13D5 | PGKGGGSMGAQTNFMPM*MID*DEQRLYEQFILQQGLE (SEQ ID NO:127) | >100 |
| L1-7D MFD | 14F11 | PGKGGGSMGAQTNFMPM*MFD*DEQRLYEQFILQQGLE (SEQ ID NO:128) | >100 |
| L1-7D MWD | 15G12 | PGKGGGSMGAQTNFMPM*MWD*DEQRLYEQFILQQGLE (SEQ ID NO:129) | >100 |
| L1-7D MLD | 16E5 | PGKGGGSMGAQTNFMPM*MLD*DEQRLYEQFILQQGLE (SEQ ID NO:130) | >100 |
| L1-7D MED | 17F9 | PGKGGGSMGAQTNFMPM*MED*DEQRLYEQFILQQGLE (SEQ ID NO:131) | >100 |
| L1-7D MMD | 18E3 | PGKGGGSMGAQTNFMPM*MMD*DEQRLYEQFILQQGLE (SEQ ID NO:132) | >100 |
| L1-7D MFD* | 14G4* | PGKGGGSMGAQTNFMPM*MFD*DEQRLYE*D*FILQQGLE (SEQ ID NO:133) | >100 |
| Lm32 KtoS | 2C10 | PG*S*GGGSMGAQTNFMPMDNDELLYEQFILQQGLE (SEQ ID NO:134) | 0.199 |
| Lm32 2X | 2C39 | PGKGGGSMGAQTNFMPMDNDELLLYEQFILQQLE*GGG*SMGAQTNFMPMDNDELLLYEQFILQQGLE (SEQ ID NO:135) | 0.005 |

Figure 17B

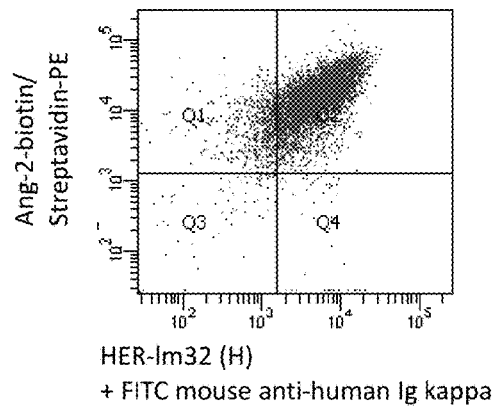
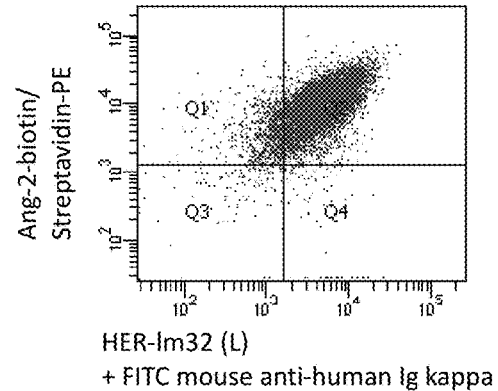
FIG. 20A
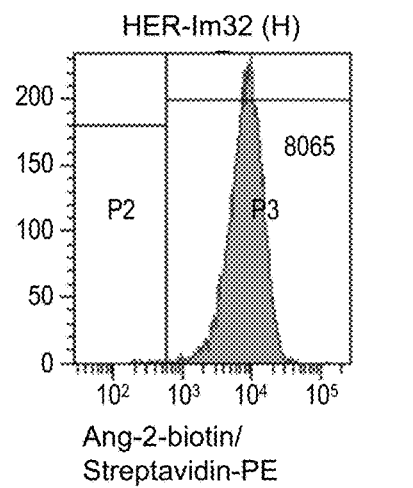
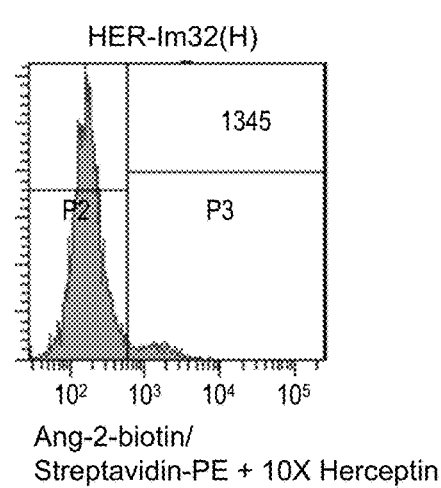
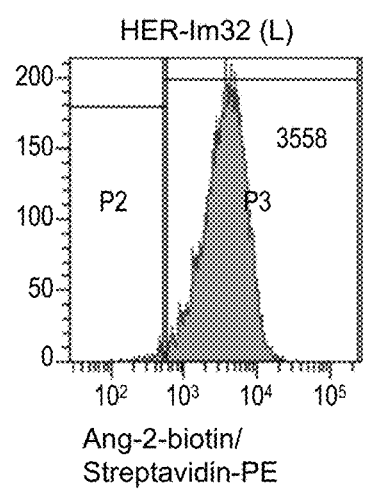
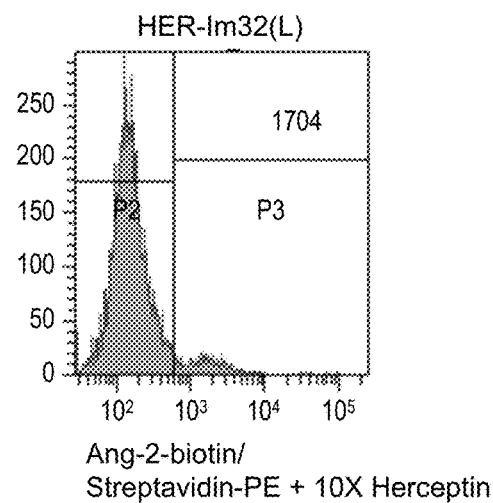
FIG. 20B

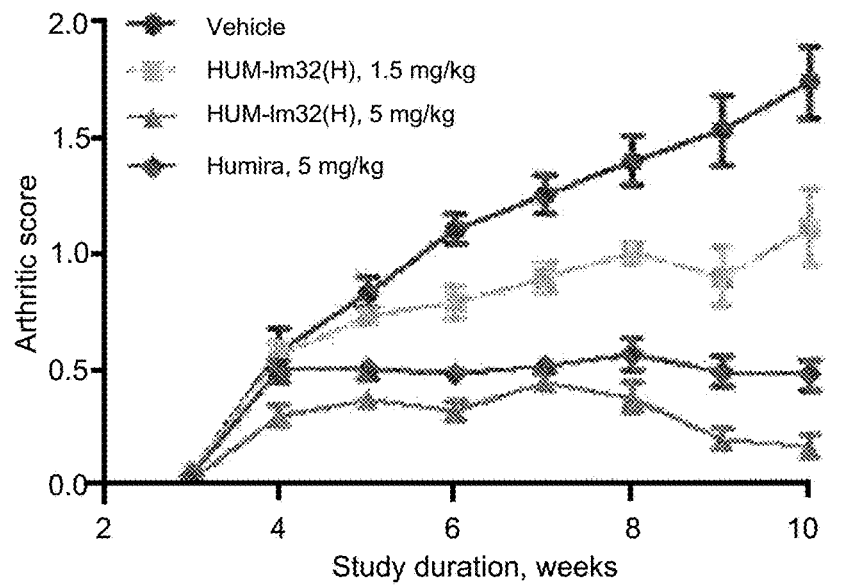
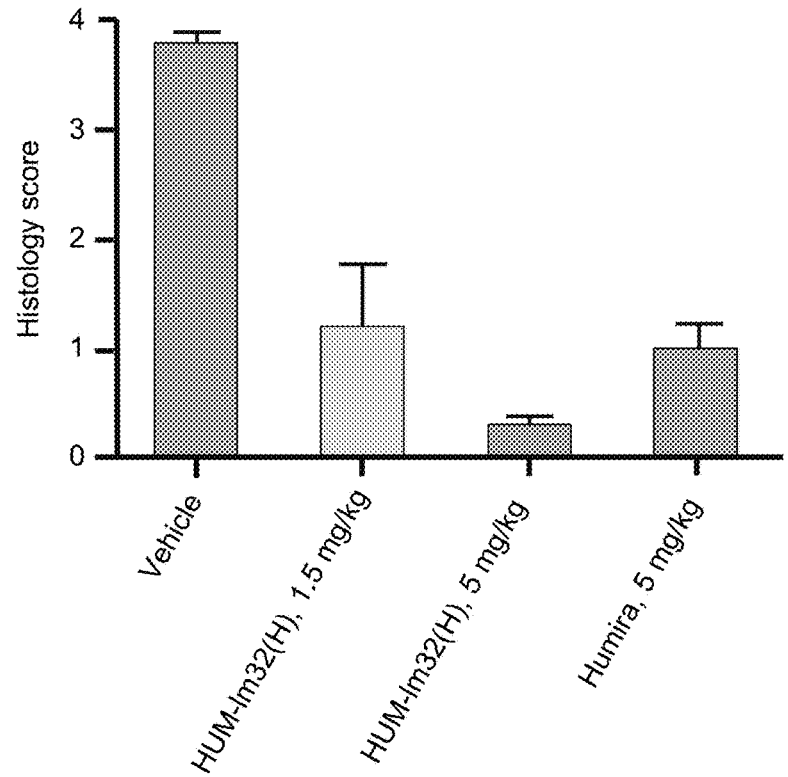
FIG. 30

EGFR-BINDING MODULAR RECOGNITION DOMAINS

BACKGROUND OF THE INVENTION

Field of the Invention

This invention relates generally to compositions containing multivalent multispecific complexes and to compositions containing multivalent and monovalent multispecific complexes having scaffolds, such as antibodies, that support such binding functionalities. The invention also generally relates to methods of making these multispecific compositions and the diagnostic and therapeutic uses of these compositions.

Background

In recent years, drug discovery efforts have primarily focused on identifying agents that modulate preselected individual targets. However, agents directed to individual targets frequently show limited efficacies and poor safety and resistance profiles, as a result of the robustness, redundancy, crosstalk, compensatory signaling networks and anti- or counter-signaling network activities associated with the therapeutic target. Consequently, drug discovery efforts have increasingly been directed toward the discovery of new multicomponent based therapies.

The development of bispecific or multi-specific molecules that target two or more targets simultaneously offers a novel and promising solution for discovering new systems-oriented multitargeted agents demonstrating improved efficacy and pharmacological properties over conventional mono-therapies. Numerous attempts to develop multispecific molecules have been based on immunoglobulin-like domains or subdomains. For example, traditionally, bispecific antibodies have been prepared by chemically linking two different monoclonal antibodies or by fusing two hybridoma cell lines to produce a hybrid-hybridoma. Other immunoglobulin-like domain-based technologies that have created multispecific, and/or multivalent molecules include dAbs, diabodies, TandAbs, nanobodies, BiTEs, SMIPs, DNLs, Affibodies, Fynomers, Kunitz Domains, Albu-dabs, DARTs, DVD-IG, Covx-bodies, peptibodies, scFv-Igs, SVD-Igs, dAb-Igs, Knobs-in-Holes, DuoBodies™ and triomAbs. Although each of these molecules may bind one or more targets, they each present challenges with respect to retention of typical Ig function (e.g., half-life, effector function), production (e.g., yield, purity), valency, simultaneous target recognition, and bioavailability.

Other attempts to generate multispecific and multivalent molecules have relied on alternative scaffolds, based VASP polypeptides, Avian pancreatic polypeptide (aPP), Tetranectin (based on CTLD3), Affilin (based on γB-crystallin/ubiquitin), knottins, SH3 domains, PDZ domains, Tendamistat, Transferrin, an ankyrin consensus repeat domain (e.g., DARPins), lipocalin protein folds (e.g., Duocalins), fibronectin (see for example, US Application Publ. Nos. 2003/0170753 and 20090155275 which are herein incorporated by reference), a domain of protein A (e.g., Affibodies), thioredoxin. Other attempts have relied on alternative scaffolds fuse or associate polypeptides of interest with albumin (e.g., ALBUdAb (Domantis/GSK) and ALB-Kunitz (Dyax)), unstructured repeat sequences of 3 or 6 amino acids (e.g., PASylation® technology and XTEN® technology), and sequences containing elastin-like repeat domains (see for example, U.S. Pat. Appl. No. 61/442,106, which is herein incorporated by reference). To date, these technologies have demonstrated limited clinical potential as robust platforms for developing diverse multispecific and multivalent therapeutic compositions.

The genetic complexity of most human malignancies and other disorders strongly suggest that interfering with a single target or pathway associated with these disorders is unlikely to produce optimal or sustained therapeutic benefit. There is, therefore, a great need for developing multispecific and multivalent therapeutics such as multispecific antibodies that are capable of interfering with the activity of multiple targets and/or signaling mechanisms in or to optimize the therapeutic benefits of treatments directed towards these disorders.

BRIEF SUMMARY OF THE INVENTION

The invention relates to compositions containing multivalent as well as multivalent and monovalent, multispecific complexes having scaffolds, such as antibodies, that support such binding functionalities. The invention is based in part on the surprising discovery that multispecific and multivalent binding compositions, such as those generated using the ZYBODY™ platform (Zyngenia, Inc.; see, e.g., Intl. Pub. No. WO 2009/088805 which is herein incorporated by reference) demonstrate dramatic synergistic biological activity compared to conventional monotherapy combinations. This synergistic activity is expected to extend to novel therapies, for treating or preventing cancer, diseases or disorders of the immune system (e.g., autoimmune diseases such as, rheumatoid arthritis, and IBD), skeletal system (e.g., osteoporosis), cardiovascular system (e.g., stroke, heart disease), nervous system (e.g., Alzheimer's), infectious disease (e.g., HIV), and other diseases or disorders described herein or otherwise known in the art.

In one embodiment, the invention is directed to treating a disease or disorder by administering a therapeutically effective amount of a multivalent and monovalent multispecific composition to a patient in need thereof. In a further embodiment, the invention is directed to treating a disease or disorder by administering a therapeutically effective amount of a multivalent and multispecific MRD-containing antibody to a patient in need thereof.

In one embodiment, the multivalent and monovalent multispecific composition contains 2 binding sites for three or more targets. In an additional embodiment, the multivalent and monovalent multispecific composition contains 2 binding sites for four or more targets. In another embodiment, the multivalent and monovalent multispecific composition contains 2 binding sites for five or more targets. According to some embodiments, at least 1, 2, 3, 4 or more of the targets are located on a cell surface. According to some embodiments, at least 1, 2, 3, 4 or more of the targets are soluble targets (e.g., chemokines, cytokines, and growth factors). In additional embodiments, the multivalent and monovalent multispecific composition binds 1, 2, 3, 4 or more of the targets described herein.

In additional embodiments, the targets bound by the multivalent and monovalent multispecific composition are associated with cancer. In a further embodiment the targets bound by the multivalent and monovalent multispecific composition are associated with 1, 2, 3, 4 or more different signaling pathways or modes of action associated with cancer.

In additional embodiments, the targets bound by the multivalent and monovalent multispecific composition are associated with a disease or disorder of the immune system. In a further embodiment the targets bound by the multivalent and monovalent multispecific composition are associated with 1, 2, 3, 4 or more different signaling pathways or modes of action associated with a disease or disorder of the immune system.

In additional embodiments, the targets bound by the multivalent and monovalent multispecific composition are associated with a disease or disorder of the skeletal system (e.g., osteoporosis), cardiovascular system, nervous system, or an infectious disease. In a further embodiment the targets bound by the multivalent and monovalent multispecific composition are associated with 1, 2, 3, 4, 5 or more different signaling pathways or modes of action associated with a disease or disorder of the skeletal system (e.g., osteoporosis), cardiovascular system, nervous system, or an infectious disease. In a further embodiment, the multivalent and monovalent multispecific composition binds at least 1, 2, 3, 4, 5 or more of the targets described herein.

In one embodiment, the multivalent and monovalent multispecific composition contains 2 binding sites for three or more targets. In an additional embodiment, the multivalent and monovalent multispecific composition contains 2 binding sites for four or more targets. In an additional embodiment, the multivalent and monovalent multispecific composition contains 2 binding sites for five or more targets.

In one embodiment, the multivalent and monovalent multispecific composition contains 2 binding sites for three or more targets. In an additional embodiment, the multivalent and monovalent multispecific composition contains 2 binding sites for four or more targets. In another embodiment, the multivalent and monovalent multispecific composition contains 2 binding sites for five or more targets. According to some embodiments, at least 1, 2, 3, 4, or more of the targets are associated with the cell membrane. According to some embodiments, at least 1, 2, 3, 4, or more of the targets are soluble targets (e.g., chemokines, cytokines, and growth factors). In additional embodiments, the multivalent and monovalent multispecific composition binds 1, 2, 3, 4, or more of the targets described herein.

In additional embodiments, the targets bound by the multivalent and monovalent multispecific composition are associated with cancer. In a further embodiment the targets bound by the multivalent and monovalent multispecific composition are associated with 1, 2, 3, 4, or more different signaling pathways or modes of action associated with cancer.

In additional embodiments, the targets bound by the multivalent and monovalent multispecific composition are associated with a disease or disorder of the immune system. In a further embodiment the targets bound by the—multivalent and monovalent multispecific composition are associated with 1, 2, 3, 4, or more different signaling pathways or modes of action associated with a disease or disorder of the immune system.

In additional embodiments, the multivalent and monovalent multispecific composition binds (1) a target on a cell or tissue of interest (e.g., a tumor associated antigen on a tumor cell, an immune cell, a diseased cell or an infectious agent) and (2) a target on an effector cell. According to one embodiment, the binding of one or more targets by the multivalent and monovalent multispecific composition directs an immune response to a cell, tissue, infectious agent, or other location of interest in a patient. In some embodiments the effector cell is a leukocyte, such as a T cell or natural killer cell. In other embodiments, the effector cell is an accessory cell, such as a myeloid cell or a dendritic cell.

In additional embodiments, the multivalent and monovalent multispecific composition binds (1) a target on a cell or tissue of interest (e.g., a tumor associated antigen on a tumor cell, an immune cell, a diseased cell or an infectious agent) and (2) a target on a leukocyte, such as a T-cell receptor molecule. According to one embodiment, the binding of one or more targets by the multivalent and monovalent multispecific composition directs an immune response to an infectious agent, cell, tissue, or other location of interest in a patient. For example, in some embodiments the multivalent and monovalent multispecific composition binds a target on the surface of a T cell. In particular embodiments, the composition binds a CD3 target selected from CD3 delta, CD3 epsilon, CD3 gamma, CD3 zeta, TCR alpha, TCR beta, and multimers of proteins in the CD3 (TCR) complex. In specific embodiments the multivalent and monovalent multispecific composition binds CD3. In other embodiments, the multivalent and monovalent multispecific composition binds CD2. In additional embodiments, the multivalent and monovalent multispecific composition binds a target expressed on a natural killer cell. Thus, in some embodiments, the multivalent and monovalent multispecific composition binds a target selected from: CD2, CD56, and CD161.

In additional embodiments, the multivalent and monovalent multispecific composition binds a target expressed on an accessory (e.g., myeloid) cell. In some embodiments, the multivalent and monovalent multispecific composition binds a target selected from: CD64 (i.e., Fc gamma RI), an MHC class 2 and its invariant chain, TLR1, TLR2, TLR4, TLR5, and TLR6.

In further embodiments, the multivalent and monovalent multispecific composition (e.g., an MRD containing antibody) has a single binding site (i.e., is monovalent) for a target. In some embodiments, the multivalent and monovalent multispecific composition has a single binding site for a target on a leukocyte, such as a T-cell (e.g., CD3), and multiple binding sites (i.e., is multivalent) for a target on a cell or tissue of interest (e.g., a tumor associated antigen on a tumor cell, such as a target disclosed herein). In further embodiments, the multispecific composition contains single binding sites for 2 different targets (i.e., monovalently binds more than one different target). In particular embodiments, the cell or tissue of interested is a cancer cell, immune cell, diseased cell, or an infectious agent.

In some embodiments, a multivalent and monovalent multispecific composition (e.g., an MRD-containing antibody) has a single binding site for CD3. In further embodiments, the multivalent and monovalent multispecific composition has a single binding site for CD3 and multiple binding sites for 1, 2, 3, 4, 5 or more different targets (e.g., a tumor antigen or other target disclosed herein). In additional embodiments, the multispecific composition has a single binding site for CD3 and a single binding site for a different target (i.e., monovalently binds CD3 and a different target). In other embodiments, a multivalent and monovalent multispecific composition has a single binding site for CD3 epsilon. In further embodiments, the multivalent and monovalent multispecific composition has a single binding site for CD3 epsilon and multiple binding sites for 1, 2, 3, 4, 5 or more different targets (e.g., a tumor antigen or other target disclosed herein). In further embodiments, the multispecific composition has a single binding site for CD3 epsilon and a single binding site for a different target (i.e., monovalently binds CD3 epsilon and a different target). In some embodiments, the multivalent and monovalent multispecific composition has multiple binding sites for a target on a cancer cell selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer.

In further embodiments, the invention is directed to treating a disease or disorder by administering a therapeutically effective amount of a multivalent and monovalent multispecific composition that has a single binding site for a target (i.e., that monovalently binds a target) to a patient in need thereof. In some embodiments, the administered multivalent and monovalent multispecific composition has a single binding site for a target on a leukocyte such as a T-cell (e.g., CD3). In further embodiments, the administered multivalent and monovalent multispecific composition has a single binding site for a target on a leukocyte such as a T-cell (e.g., CD3) and multiple binding sites for (i.e., is capable of multivalently binding) a target located on a cell or tissue of interest (e.g., a tumor antigen on a tumor cell). In further embodiments, the multispecific composition has a single binding site for a target on a leukocyte (e.g., CD3) and a single binding site for a different target. In some embodiments, the cell of interest is a tumor cell from a cancer selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer. In additional embodiments, the multivalent and monovalent multispecific composition has multiple binding sites for a target on a neurological tumor. In particular embodiments, the neurological tumor is a glioma (e.g., a glioblastoma, glioblastoma multiforme (GSM), and astrocytoma), ependymoma, oligodendroglioma, neurofibroma, sarcoma, medulloblastoma, primitive neuroectodermal tumor, pituitary adenoma, neuroblastoma or cancer of the meninges (e.g., meningioma, meningiosarcoma and gliomatosis).

In further embodiments, the invention is directed to treating a disease or disorder by administering to a patient in need thereof, a therapeutically effective amount of a multivalent and monovalent multispecific composition (e.g., an MRD-containing antibody) that has a single binding site for a target (i.e., that monovalently binds a target) and multiple binding sites for 1, 2, 3, 4, 5 or more different targets. In further embodiments, the multivalent and monovalent multispecific composition has single binding sites for 2 different targets. In some embodiments, the multivalent and monovalent multispecific composition has multiple binding sites for a target on a cancer cell selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer.

In additional embodiments, the invention is directed to treating a disease or disorder by administering to a patient in need thereof, a therapeutically effective amount of a multivalent and monovalent multispecific composition (e.g., an MRD-containing antibody) that has a single binding site for CD3 (e.g., CD3 epsilon) that monovalently binds CD3 and multiple binding sites for 1, 2, 3, 4, 5 or more different targets located on a cell or tissue of interest (e.g., a tumor antigen on a tumor cell). In some embodiments, the administered multivalent and monovalent multispecific composition has a single binding site for CD3 (e.g., CD3 epsilon) and a single binding site for a different target and also has multiple binding sites for a target located on a cell or tissue of interest (e.g., a tumor antigen on a tumor cell). In some embodiments, the multivalent and monovalent multispecific composition has multiple binding sites for a target on a cancer cell selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer.

In further embodiments, the multivalent and monovalent multispecific composition (e.g., an MRD-containing antibody) has a single binding site for (i.e., monovalently binds) a cell surface target that requires multimerization for signaling. In some embodiments, the multivalent and monovalent multispecific composition has a single binding site for a growth factor receptor. In other embodiments, the multivalent and monovalent multispecific composition has a single binding site for a TNF receptor superfamily member. In additional embodiments, the multispecific composition additionally has a single binding site for a different target (i.e., monovalently binds more than one different target).

In additional embodiments, the multivalent and monovalent multispecific composition (e.g., MRD-containing antibody) binds a target associated with an endogenous blood brain barrier (BBB) receptor mediated transport system and is capable of crossing to the brain (cerebrospinal fluid) side of the BBB. In some embodiments, the multivalent and monovalent multispecific composition has two or more binding sites for a target antigen associated with an endogenous BBB receptor mediated transport system. In additional embodiments, the multivalent and monovalent multispecific composition has a single binding site for a target associated with an endogenous BBB receptor mediated transport system (e.g., the insulin receptor, transferrin receptor, leptin receptor, lipoprotein receptor, and the IGF receptor mediated transport systems). In further embodiments, the multivalent and monovalent multispecific composition additionally binds 1, 2, 3, 4, 5, or more targets located on the brain side of the BBB. In particular embodiments, the MRD-containing antibody binds 1, 2, 3, 4, 5, or more targets associated with a neurological disease or disorder. In another embodiment, the multivalent and monovalent multispecific composition is administered to a patient to treat a brain cancer, metastatic cancer of the brain, or primary cancer of the brain. In a further embodiment, the multivalent and monovalent multispecific composition is administered to a patient to treat brain injury, stroke, spinal cord injury, or to manage pain.

In additional embodiments, targets bound by the multivalent and monovalent multispecific composition (e.g., MRD-containing antibody) are associated with a disease or disorder of the skeletal system (e.g., osteoporosis), cardiovascular system, nervous system, or an infectious disease. In a further embodiment a targets bound by the multivalent and monovalent multispecific composition are associated with 1, 2, 3, 4, 5 or more different signaling pathways or modes of action associated with one or more of the above diseases or disorders. In a further embodiment, the multivalent and monovalent multispecific composition binds 1, 2, 3, 4, 5 or more of the targets described herein.

In one embodiment, the multivalent and monovalent multispecific composition is a ZYBODY™ (referred to herein as an "MRD-containing antibody," or the like). In a further embodiment, the MRD-containing antibody contains binding sites for three or more targets. In an additional embodiment, the MRD-containing antibody contains 2 binding sites for four or more targets. In an additional embodiment, the MRD-containing antibody contains 2 binding sites for five or more targets.

In one embodiment, the multivalent and monovalent multispecific composition (e.g., MRD-containing antibody) contains 2 binding sites for three or more targets. In an additional embodiment, the multispecific composition (e.g., MRD-containing antibody) contains 2 binding sites for four or more targets. In another embodiment, the multispecific composition (e.g., MRD-containing antibody) contains 2 binding sites for five or more targets. According to some embodiments, at least 1, 2, 3, 4 or more of the targets are located on a cell surface. According to some embodiments, at least 1, 2, 3, 4 or more of the targets are soluble targets (e.g., chemokines, cytokines, and growth factors). In additional embodiments, the MRD-containing antibody binds at least 1, 2, 3, 4, 5 or more of the targets described herein.

In additional embodiments, the targets bound by the multivalent and monovalent multispecific composition (e.g., MRD-containing antibody) are associated with cancer. In a further embodiment the targets bound by MRD-containing antibody are associated with 1, 2, 3, 4 or more different signaling pathways or modes of action associated with cancer.

In additional embodiments, a target bound by the multivalent and monovalent multispecific composition (e.g., MRD-containing antibody) is associated with a disease or disorder of the immune system. In a further embodiment the targets bound by the MRD-containing antibody are associated with 1, 2, 3, 4, 5 or more different signaling pathways or modes of action associated with a disease or disorder of the immune system.

In additional embodiments, a target bound by the multivalent and monovalent multispecific composition (e.g., MRD-containing antibody) is associated with a disease or disorder of the skeletal system, cardiovascular system, nervous system, or an infectious disease. In a further embodiment a target bound by the MRD-containing antibody is associated with 1, 2, 3, 4 or more different signaling pathways or modes of action associated with one or more of the above diseases or disorders. In another embodiment, the MRD-containing antibody binds 1, 2, 3, 4 or more of the targets described herein.

The multivalent and multispecific compositions of the invention (e.g., MRD-containing antibodies) provide the ability to selectively target multiple targets (e.g., receptors and microenvironment associated targets) having for example, different, overlapping, or redundant mechanisms of action associated with the etiology or pathophysiology of a disease or disorder.

In additional embodiments, the invention encompasses a multivalent and monovalent multispecific composition (e.g., an MRD-containing antibody) that is covalently or otherwise associated with a cytotoxic agent. According to some embodiments, the cytoxic agent is covalently attached to an MRD-containing antibody by a linker. According to some embodiments, the cytotoxic agent is a chemotherapeutic agent, growth inhibitory agent, toxin (e.g., an enzymatically active toxin of bacterial, fungal, plant, or animal origin, or fragments thereof), radioactive isotope (i.e., a radioconjugate), or prodrug. The compositions of the invention are optionally linked to the cytotoxic agent by a linker. In particular embodiments, a linker attaching the multivalent and monovalent multispecific composition and the cytotoxic agent is cleavable by a protease. In particular embodiments, a linker attaching the multivalent and monovalent multispecific composition and the cytotoxic agent is cleavable under low pH or reducing conditions. Methods of using composition-cytoxic agent compositions of the invention (e.g., MRD-containing antibody drug conjugates) are also encompassed by the invention.

In additional embodiments, the multivalent and multispecific compositions is covalently or otherwise associated with a cytotoxic agent selected from, for example, a toxin, enterotoxin, neurotoxin, leukocidin or hemolysin, a chemotherapeutic agent, a drug moiety (e.g., a chemotherapeutic agent or prodrug), an antibiotic, a radioactive isotope, a chelating ligand (e.g., DOTA, DOTP, DOTMA, DTPA and TETA), and a nucleolytic enzyme. In particular embodiments, the cytotoxic agent is selected from auristatin and dolostantin, MMAE, MMAF, and a maytansinoid derivative (e.g., the DM1 (N(2')-deacetyl-N(2')-(3-mercapto-1-oxopropyl)-maytansine), DM3 (N(2')-deacetyl-N2-(4-mercapto-1-oxopentyl)-maytansine), and DM4 (N(2)-deacetyl-N2-(4-mercapto-4-methyl-1-oxopentyl)-maytansine). In additional embodiments, the multivalent and multispecific composition is covalently or otherwise associated with a cytostatic agent.

In further embodiments, a multivalent and monovalent multispecific composition of the invention (e.g., an MRD-containing antibody) is administered in combination with a multitargeting therapeutic. In one embodiment, a multivalent and monovalent multispecific composition is administered in combination with a multitargeting protein kinase inhibitor. In another embodiment, a multivalent and monovalent multispecific composition is administered in combination with an NFKB inhibitor. In an additional embodiment, a multivalent and monovalent multispecific composition is administered in combination with an HDAC inhibitor. In a further embodiment, a multivalent and monovalent multispecific composition is administered in combination with an HSP70 or HSP90 inhibitor. In a further embodiment, a multivalent and monovalent multispecific composition is administered in combination with chemotherapy.

In some embodiments, a multivalent and monovalent multispecific composition of the invention (e.g., an MRD-containing antibody) is administered in combination with a monospecific therapeutic (e.g., a monoclonal antibody).

In some embodiments, a multivalent and monovalent multispecific composition of the invention is a full-length antibody comprising at least one modular recognition domain (MRD). In some embodiments, the full-length antibody comprises multiple MRDs. In additional embodiments, the full-length antibody comprises more than one type of MRD (i.e., multiple MRDs having the same or different specificities). Also embodied in the present invention are variants and derivatives of such antibody complexes.

The MRDs of the MRD containing antibodies can be operably attached to the antibodies at any location on the antibody (e.g., the amino terminus of the heavy chain or light chain or the carboxyl terminus of the heavy chain or light chain), can be linked at the same or different termini, and are optionally operably linked to one another or to the antibody by a linker.

The antibodies of the MRD containing antibodies can be any immunoglobulin molecule that binds to an antigen and can be of any type, class, or subclass. In some embodiments, the antibody is humanized or human. In other embodiments, the antibodies also include modifications that do not interfere with their ability to bind antigen. In particular embodiments, the multivalent and multispecific compositions (e.g., MRD-containing antibodies) include modifications that increase ADCC, decrease ADCC, increase CDC, or decrease CDC, that increase antibody half-life, or decrease antibody half-life compared to the antibody without the modification.

The antibodies of the multivalent and multispecific compositions (e.g., MRD-containing antibodies) of the invention can be any antibody that binds to a target of therapeutic or diagnostic value. In preferred embodiments, the antibody of the MRD-containing antibody binds to a validated target. In some embodiments, the antibodies corresponding to the MRD containing antibodies are in clinical trials for regulatory approval. In some embodiments, the antibodies corresponding to the MRD containing antibodies are marketed.

In one embodiment, the antibody binds to a cell surface antigen. In another embodiment, the antibody binds to an angiogenic factor. In a further embodiment, the antibody binds to an angiogenic receptor.

In some embodiments, the antibody of the MRD-containing antibody binds to a target selected from: EGFR, ErbB2, ErbB3, ErbB4, CD20, insulin-like growth factor-I receptor, VEGF, VEGF-R and prostate specific membrane antigen. In additional embodiments the antibody of the MRD-containing antibody binds to VEGF, VEGFR1, EGFR, ErbB2, IGF-IR, cMET, FGFR1, FGFR2, and CD20.

In one embodiment, the antibody of the MRD-containing antibody binds to EGFR. In another specific embodiment, the antibody is Erbitux®, nimotuzumab, or zalutumumab (e.g., Genmab). In another embodiment, the antibody binds to the same epitope as Erbitux® antibody or competitively inhibits binding of the Erbitux® antibody to EGFR. In a further specific embodiment, the antibody is the Erbitux® antibody. In one specific embodiment, the antibody binds to the same epitope as Erbitux®, nimotuzumab, zalutumumab (e.g., Genmab) antibody. In another specific embodiment, the antibody component, MRD component, and/or MRD-containing antibody competitively inhibits binding of Erbitux®, nimotuzumab, zalutumumab antibody to EGFR.

In one embodiment, an MRD-containing antibody binds EGFR and a target selected from: HGF, CD64, CDCP1, RON, cMET, ErbB2, ErbB3, IGF1R, PLGF, RGMa, PDGFRa, PDGFRb, VEGFR1, VEGFR2, TNFRSF10A (DR4), TNFRSF10B (DR5), TNFRSF21 (DR6), IGF1,2, IGF2, CD3, CD4, and NKG2D. In some embodiments, the multivalent and monovalent multispecific composition (e.g., MRD-containing antibodies) binds at least 1, 2, 3, 4, 5 or more of these targets. In specific embodiments, the antibody component of the MRD-containing antibody binds EGFR. In further embodiments, the antibody component of the MRD-containing antibody is nimotuzumab, zalutumumab. In specific embodiments, the antibody component of the MRD-containing antibody is Erbitux®.

In a specific embodiment, the antibody of the MRD-containing antibody binds to ErbB2. In one embodiment, the antibody is HERCEPTIN® (trastuzumab) antibody or competitively inhibits HERCEPTIN® (trastuzumab) antibody binding to ErbB2.

In another specific embodiment, the antibody binds to VEGF. In another specific embodiment, the antibody binds to the same epitope as AVASTIN® (bevacizumab) antibody or competitively inhibits AVASTIN® antibody. In a further specific embodiment, the antibody is the AVASTIN® antibody.

In some embodiments, the antibody binds to a target that is associated with a disease or disorder of the immune system. In one embodiment, the antibody binds to TNF. In another specific embodiment, the antibody binds to the same epitope as HUMIRA® (adalimumab) antibody or competitively inhibits HUMIRA® antibody. In a further specific embodiment, the antibody is the HUMIRA® antibody. In one embodiment, the antibody binds to TNF. In another specific embodiment, the antibody binds to the same epitope as SIMPONI™ (golimumab) antibody or competitively inhibits SIMPONI™ antibody. In a further specific embodiment, the antibody is the SIMPONI™ antibody.

In some embodiments, the antibody component of the MRD containing antibody binds to a target that is associated with a disease or disorder of the metabolic, cardiovascular, musculoskeletal, neurological, or skeletal system. In other embodiments, the antibody component of the MRD containing antibody binds to a target that is associated with yeast, fungal, viral or bacterial infection or disease.

The invention also encompasses, MRDs, compositions comprising MRDs (e.g., 0antibodies and/or other compositions), polynucleotides encoding MRDs, methods of manufacturing MRDs, and methods of using the MRDs of the invention. In one embodiment, the MRD is about 2 to 150 amino acids. In another embodiment, the MRD is about 2 to 60 amino acids. MRDs can be linked to an antibody or other MRDs directly or through a linker. The MRDs can be any target binding peptide. In some embodiments, the MRD target is a soluble factor. In other embodiments, the MRD target is a transmembrane protein such as a cell surface receptor. In another embodiment, the target of the MRD is a cellular antigen. In a specific embodiment, the target of the MRD is CD20.

In another embodiment, the target of the MRD is an integrin. In one aspect, the peptide sequence of the integrin targeting MRD is YCRGDCT (SEQ ID NO:3). In another aspect, the peptide sequence of the integrin targeting MRD is PCRGDCL (SEQ ID NO:4). In yet another aspect, the peptide sequence of the integrin targeting MRD is TCRGDCY (SEQ ID NO:5). In another aspect, the peptide sequence of the integrin targeting MRD is LCRGDCF (SEQ ID NO:6).

In an additional embodiment, the target of the MRD is an angiogenic cytokine. In one aspect, the peptide sequence of the angiogenic cytokine targeting (i.e., binding) MRD is MGAQTNFMPMDDLEQRLYEQFILQQGLE (SEQ ID NO:7).

In one embodiment, the target of the MRD is ErbB2. In another embodiment, the target to which the MRD binds is ErbB3. In an additional embodiment, the target to which the MRD binds is tumor-associated surface antigen or an epithelial cell adhesion molecule (Ep-CAM).

In one embodiment, the target to which the MRD binds is VEGF. In one aspect, the peptide sequence of the VEGF targeting MRD is VEPNCDIHVMWEWECFERL (SEQ ID NO:13).

In one embodiment, the target to which the MRD binds is an insulin-like growth factor-I receptor (IGF1R). An illustrative IGF1R targeting MRD includes, for example, a peptide sequence having the formula: NFYQCIDLLMAYPAEKSRGQWQECRTGG (SEQ ID NO:37);

In one embodiment, the target of the MRD is a tumor antigen. The "tumor antigen" as used herein may be understood as both those antigens (including mutations) exclusively expressed on tumor cells (i.e., tumor-specific antigens) and those antigens expressed on tumor cells and normal cells (e.g., antigens overexpressed on tumor cells).

In one embodiment, the target of the MRD is an epidermal growth factor receptor (EGFR). In another embodiment of the present invention, the target of the MRD is an angiogenic factor. In an additional embodiment, the target of the MRD is an angiogenic receptor.

In another embodiment, the MRD is a vascular homing peptide.

In one embodiment, the target of the MRD is a nerve growth factor.

In another embodiment, the antibody and/or MRD binds to EGFR, ErbB2, ErbB3, ErbB4, CD20, insulin-like growth factor-I receptor, or prostate specific membrane antigen.

The present invention also relates to an isolated polynucleotide comprising a nucleotide sequence encoding an MRD-containing antibody. In one aspect, a vector comprises a polynucleotide sequence encoding an MRD-containing antibody. In another aspect, the polynucleotide sequence encoding an MRD-containing antibody is operatively linked with a regulatory sequence that controls expression on the polynucleotide. In an additional aspect, a host cell comprises the polynucleotide sequence encoding an MRD-containing antibody.

Methods of making multivalent and multispecific compositions (e.g., MRD-containing antibodies) are also provided, as are the use of these MRD-antibody fusions in diagnostic and therapeutic applications. The present invention also relates to methods of designing and making multivalent and multispecific compositions (e.g., MRD-containing antibodies) having a full-length antibody comprising a MRD. In one aspect, the MRD is derived from a phage display library. In another aspect, the MRD is derived from natural ligands. In another aspect, the MRD is derived from yeast display or RNA display technology.

The present invention also relates to a method of treating or preventing a disease or disorder in a subject (patient) in need thereof, comprising administering an antibody comprising an MRD to the subject (patient). In one aspect, the disease is cancer. In another aspect, undesired angiogenesis in inhibited. In another aspect, angiogenesis is modulated. In yet another aspect, tumor growth is inhibited.

Certain embodiments provide for methods of treating or preventing a disease, disorder, or injury comprising administering to a patient in need thereof, a therapeutically effective amount of a multivalent and monovalent multispecific composition (e.g., an MRD-containing antibody) to a patient in need thereof. In some embodiments, the disease, disorder or injury is cancer. In other embodiments, the disease, disorder or injury is a disorder of the immune system. In one embodiment, the disorder of the immune system is inflammation. In another embodiment, the disorder of the immune system is an autoimmune disease. In an additional embodiment, the disorder of the immune system is selected from the group consisting of: rheumatoid arthritis, Crohn's disease, systemic lupus erythematous, inflammatory bowel disease, psoriasis, diabetes, ulcerative colitis, and multiple sclerosis. In one embodiment, the disease, disorder or injury is a metabolic disease. In another embodiment, the disease, disorder, or injury is an infectious disease. In specific embodiments, the infectious disease is human immunodeficiency virus (HIV) infection or AIDS, botulism, anthrax, or *clostridium difficile*. In other embodiments, the disease, disorder, or injury is neurological. In a specific embodiment, the neurological disease, disorder or injury is pain. In a more specific embodiment, the pain is, acute pain or chronic pain.

In another embodiment, a method of treatment or prevention comprising administering an additional therapeutic agent along with an antibody comprising an MRD is provided. In other embodiments, the methods of treatment or prevention comprise administering an antibody comprising more than one type of MRD.

BRIEF DESCRIPTION OF THE DRAWINGS/FIGURES

FIG. 17A depicts the dose response curves of MRD-maltose binding protein (MBP) fusions assayed for direct binding to Ang2.

FIG. 17B indicates MRD-MBP fusion proteins tested, the amino acid sequence of the MRD, and the EC50 values (calculated using a 4 parameter fit). The MXD sequence motif in the MRD components of the MRD-MBP fusions is underlined and mutated residues are in bold and italics.

Figure 18A:
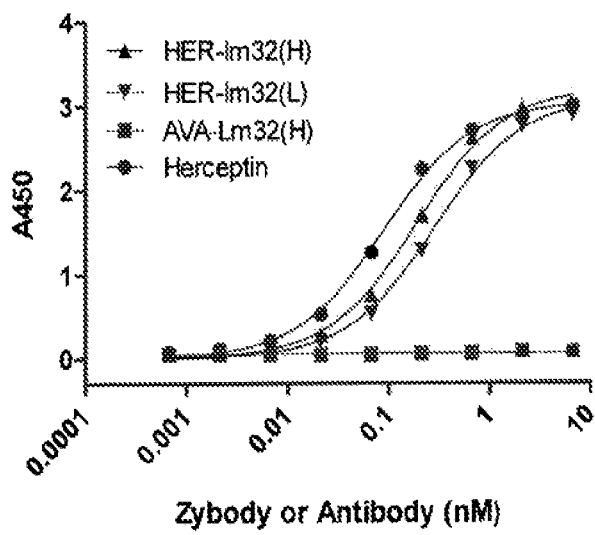

FIG. 18A depicts the results of an assay for direct binding of a HERCEPTIN® based zybody (i.e. an MRD containing HERCEPTIN® antibody sequences) antibody-MRDs and a HERCEPTIN® antibody to Her2 (ErbB2) Fc in the presence of biotinylated Ang2. Binding was detected with HRP-conjugated anti-human kappa chain mAb.

Figure 18B:
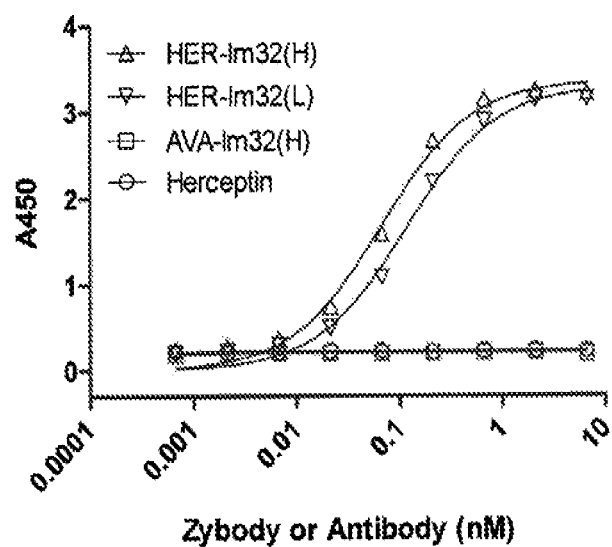

FIG. 18B depicts the results of an assay for direct binding of a HERCEPTIN® based zybody (i.e., an MRD containing HERCEPTIN® antibody sequences) and a HERCEPTIN® antibody to Her2 Fc in the presence of biotinylated Ang2. Binding was detected with horseradish peroxidase (HRP)-conjugated streptavidin.

Figure 19A:
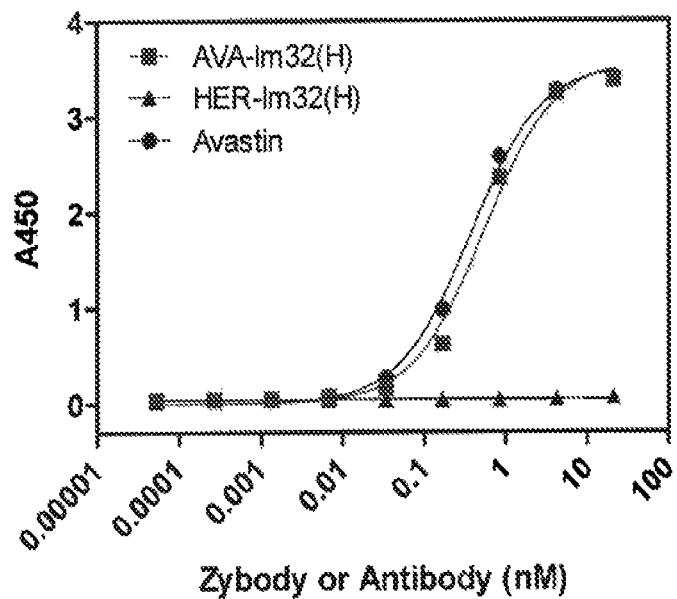

FIG. 19A depicts the results of an assay for direct binding of antibody-MRDs and an AVASTIN® antibody to VEGF in the presence of biotinylated Ang2. Binding was detected with HRP-conjugated anti-human kappa chain mAb.

Figure 19B:
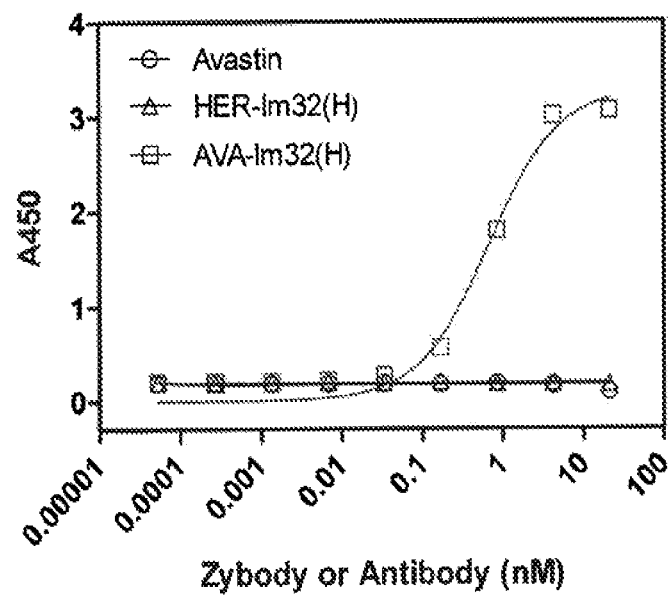

FIG. 19B depicts the results of an assay for direct binding of antibody-MRDs and an AVASTIN® antibody to VEGF in the presence of biotinylated Ang2. Binding was detected with HRP-conjugated streptavidin.

FIG. 20A depicts the results of a flow cytometry assay which demonstrates that antibody-MRDs simultaneously bind Her2 and Ang2 on BT-474 breast cancer cells.

FIG. 20B depicts binding of antibody-MRDs to HER2 on BT-474 breast cancer cells.

Figure 21:
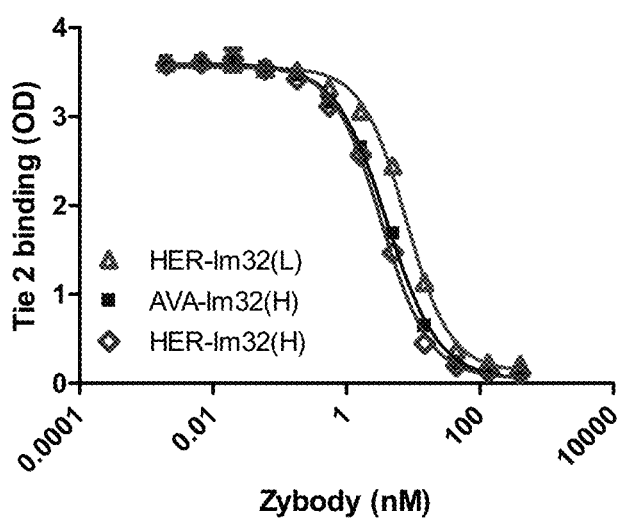

FIG. 21 depicts the results of an ELISA assay that demonstrates the inhibitory effect of antibody-MRDs on TIE-2 binding to plate immobilized Ang2.

Figure 22:
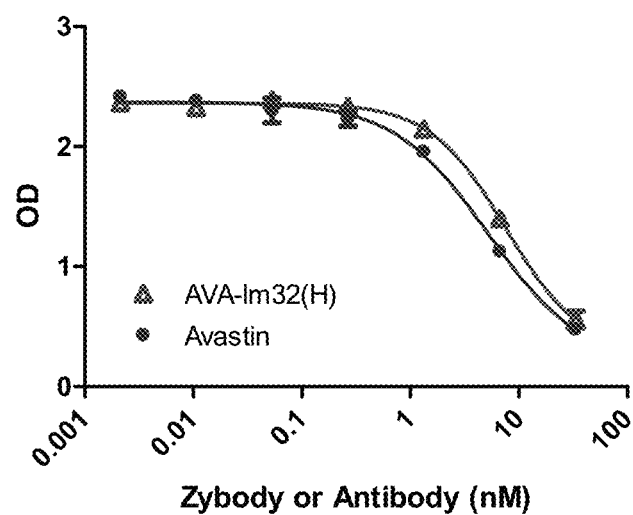

FIG. 22 depicts the results of a competitive binding assay that demonstrates the inhibition of binding of biotinylated antibody by antibody-MRD and unlabeled antibody.

Figure 23:
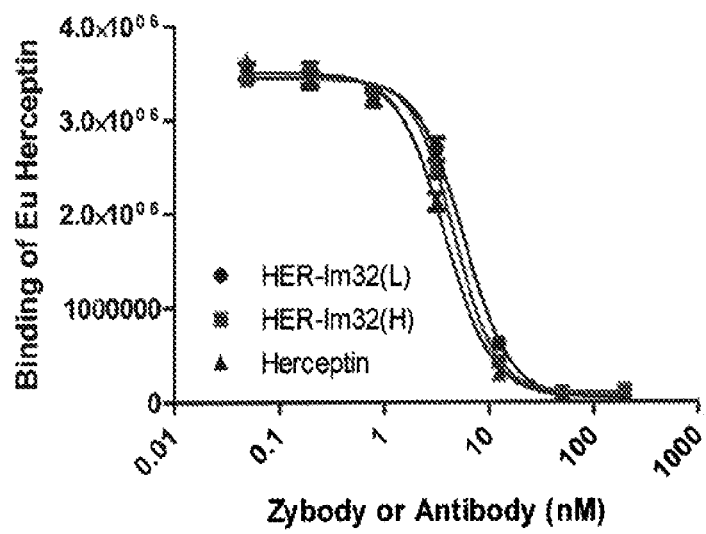

FIG. 23 depicts the results of a competitive binding assay that illustrates the inhibition of labeled antibody binding to BT-474 cells by antibody-MRDs and unlabeled antibody.

Figure 24A:
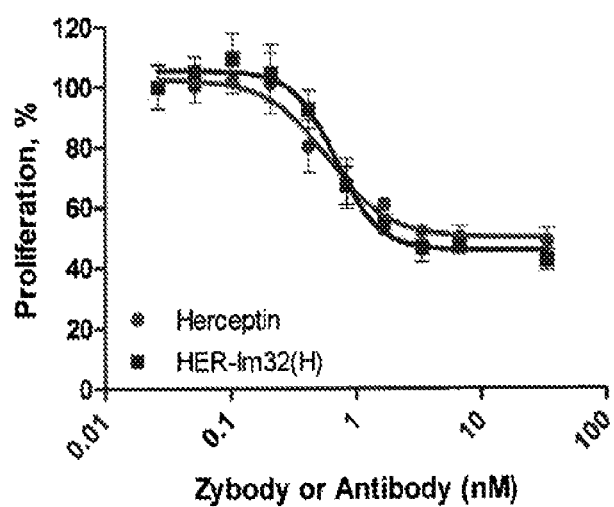

FIG. 24A depicts the fitted dose curves illustrating the inhibition of BT-474 cell proliferation by HERCEPTIN® with the lm32 MRD (SEQ ID NO:8) fused to the heavy chain and HERCEPTIN®.

Figure 24B:
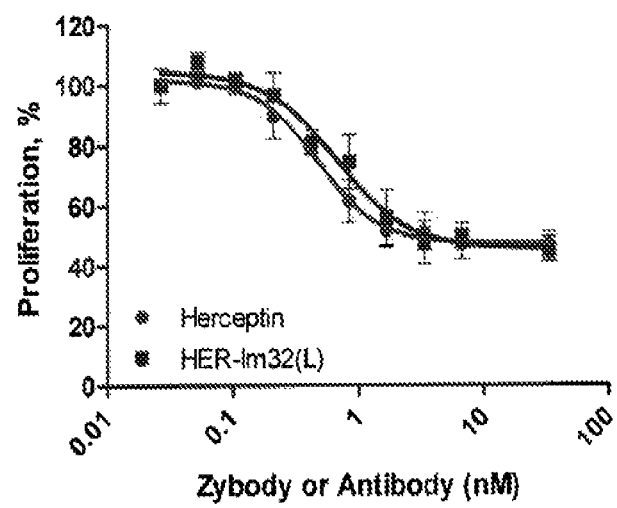

FIG. 24B depicts the fitted dose curves illustrating the inhibition of BT-474 cell proliferation by HERCEPTIN® with the lm32 MRD fused to the light chain and HERCEPTIN®.

Figure 24C:
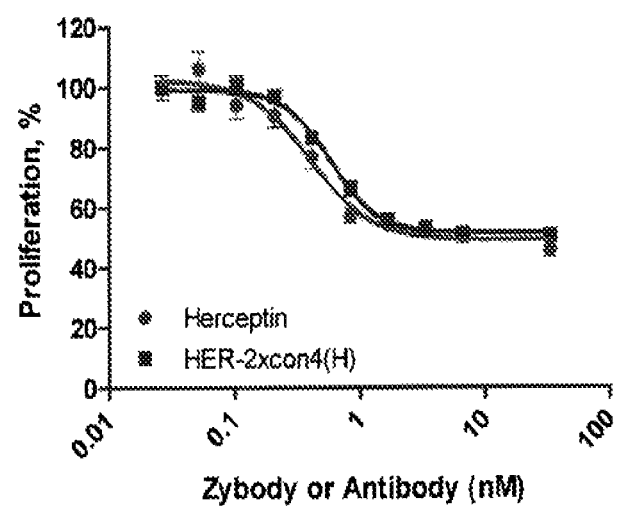

FIG. 24C depicts the fitted dose curves illustrating the inhibition of BT-474 cell proliferation by HERCEPTIN® with the 2×con4 MRD fused to the heavy chain and HERCEPTIN®.

Figure 25A:
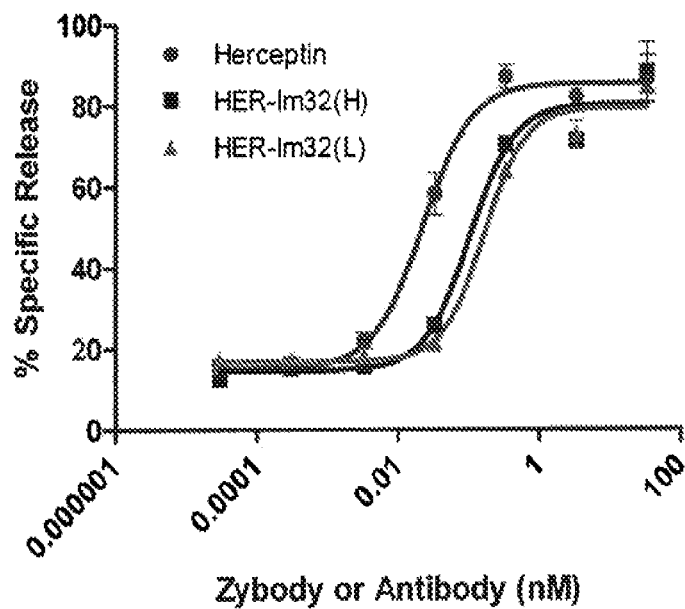

FIG. 25A depicts the results of a cytotoxicity assay illustrating ADCC-mediated killing of BT-474 cells by HERCEPTIN® with the lm32 MRD fused to the heavy chain, HERCEPTIN® with the lm32 MRD fused to the light chain, and HERCEPTIN®.

Figure 25B:
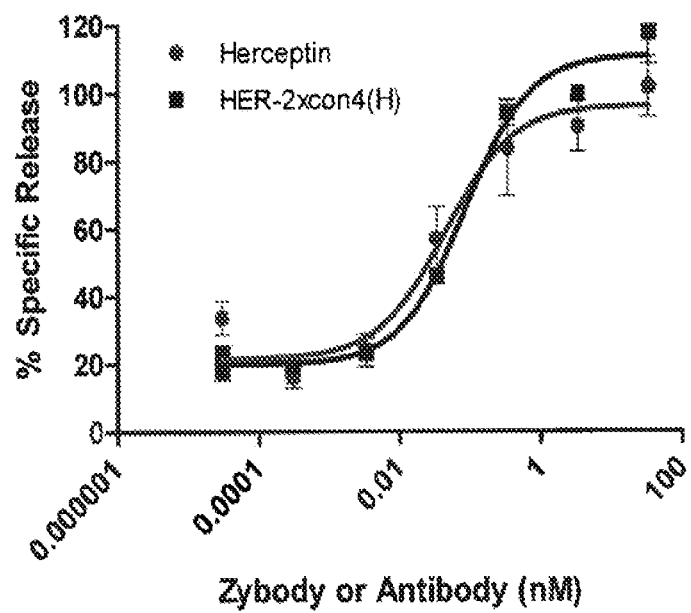

FIG. 25B depicts the results of a cytotoxicity assay illustrating ADCC-mediated killing of BT-474 cells by HERCEPTIN® with the 2×con4 MRD fused to the heavy chain, and HERCEPTIN®.

Figure 26A:
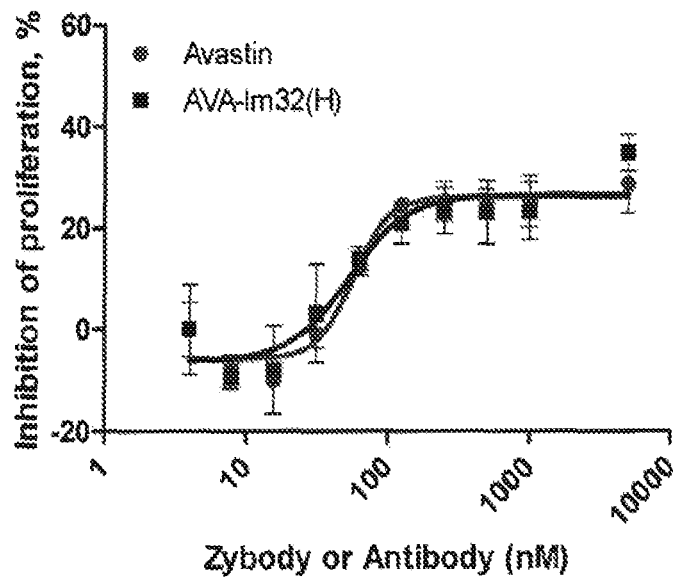

FIG. 26A depicts the inhibition of HUVEC proliferation by AVASTIN® with the lm32 MRD fused to the heavy chain and AVASTIN® using HUVECs obtained from GlycoTech (Gaithersburg, Md.).

Figure 26B:
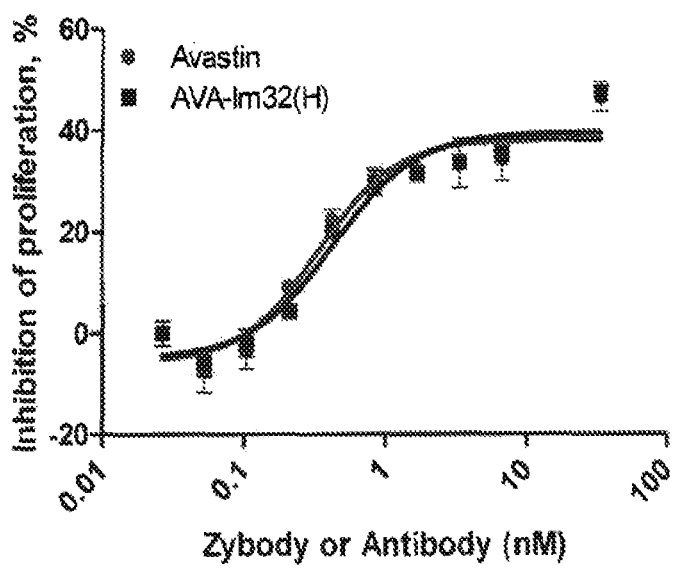

FIG. 26B depicts the inhibition of HUVEC proliferation by AVASTIN® with the lm32 MRD fused to the heavy chain and AVASTIN® using HUVECs obtained from Lonza.

Figure 27:
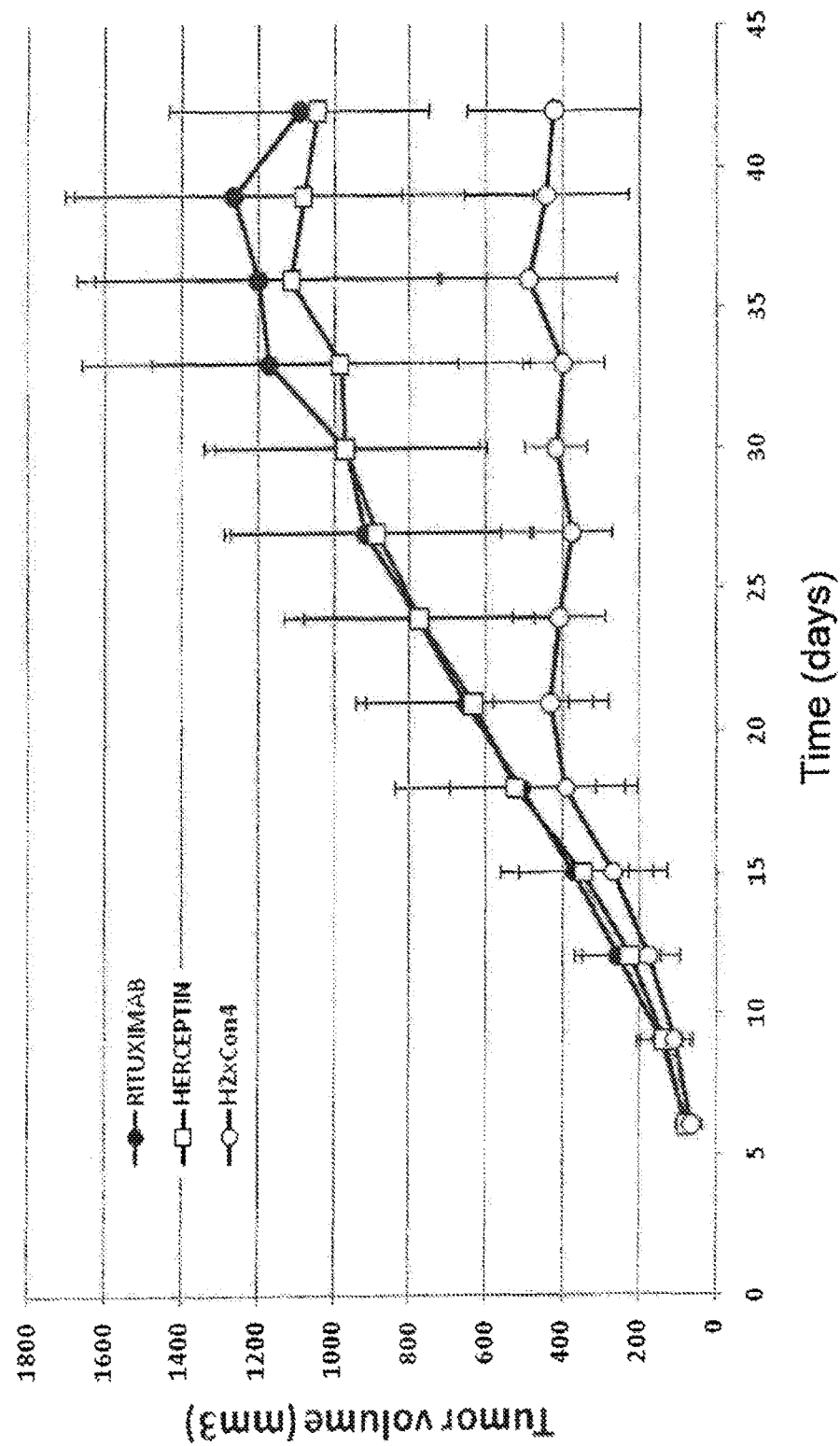

FIG. 27 depicts the effect of RITUXIMAB®, HERCEPTIN®, and an MRD-containing antibody on tumor volume in vivo.

Figure 28:
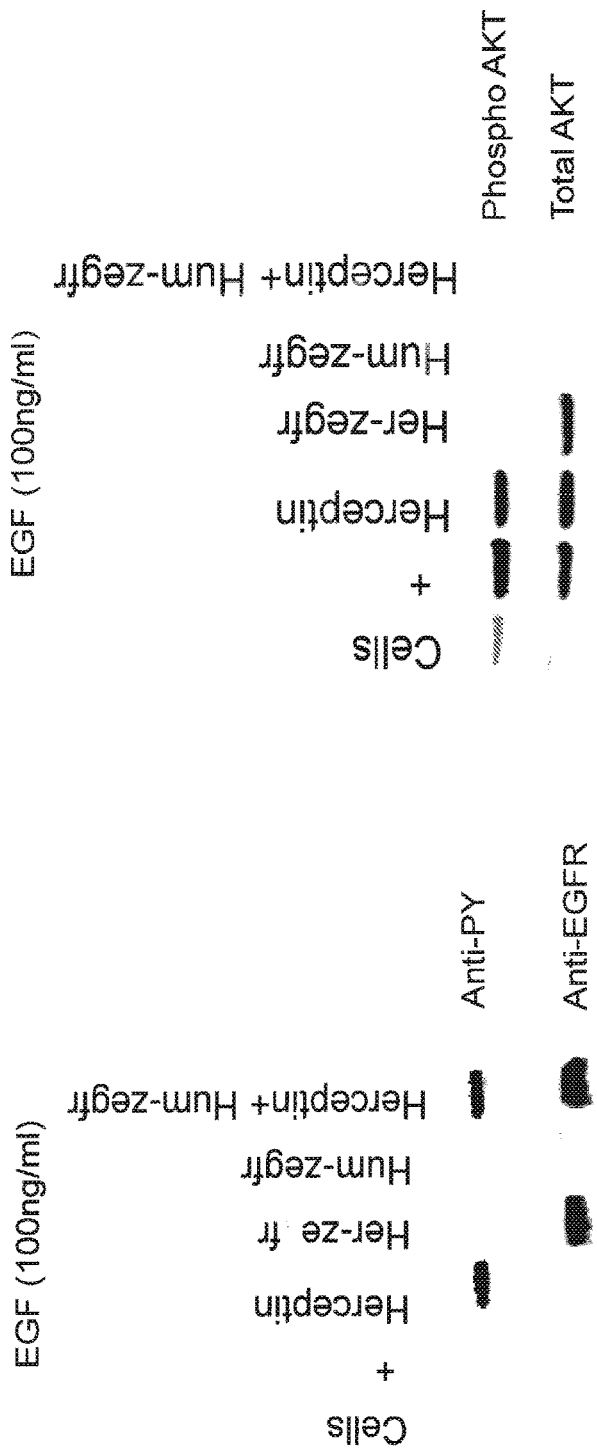

FIG. 28 depicts the increased effect of an antibody-containing MRD on receptor phosphorylation and AKT activation compared to the effect of an antibody in combination with the MRD.

Figure 29A:
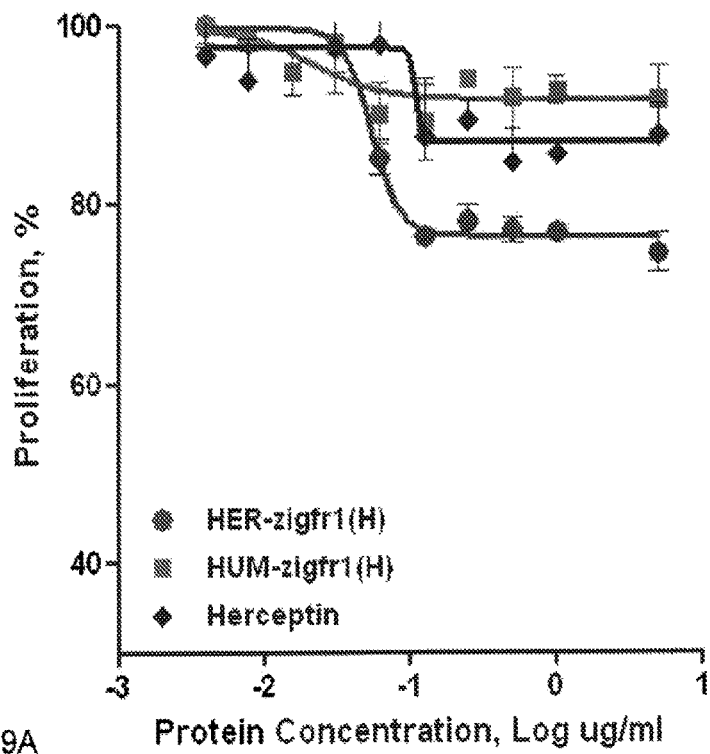

FIG. 29A depicts the increased effect of a bispecific MRD-containing antibody on cell proliferation compared to the effect of the antibody or the antibody in combination with the MRD.

Figure 29B:
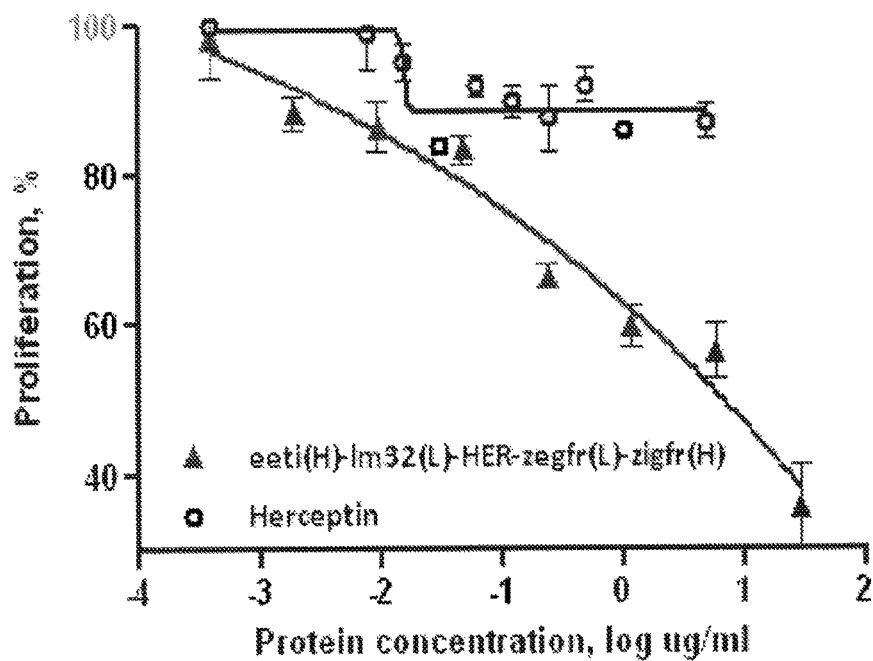

FIG. 29B depicts the increased effect of a pentaspecific MRD-containing antibody on cell proliferation compared to the effect of the antibody or the antibody in combination with the MRD.

FIG. 30 depicts the increased efficacy of a HUMIRA antibody containing an Ang2-binding MRD in an arthritis model compared to HUMIRA.

Figure 31:
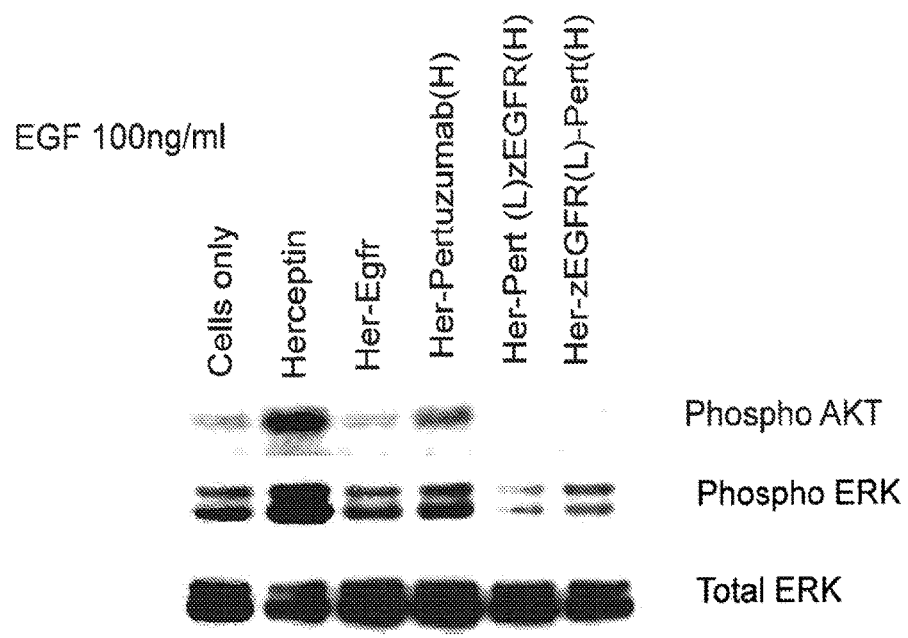

FIG. 31 shows inhibition of EGF-induced signaling in SK-BR3 cells by zybodies.

Figure 32:
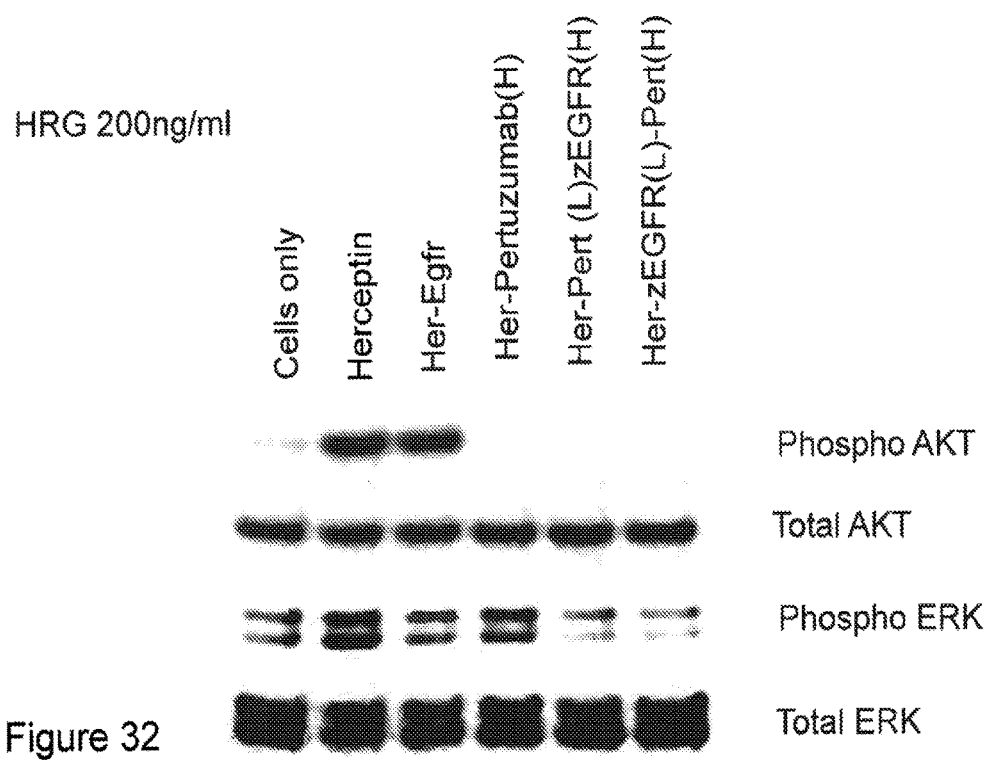

FIG. 32 shows inhibition of Heregulin-induced signaling in SK-BR3 zybodies.

Figure 33:
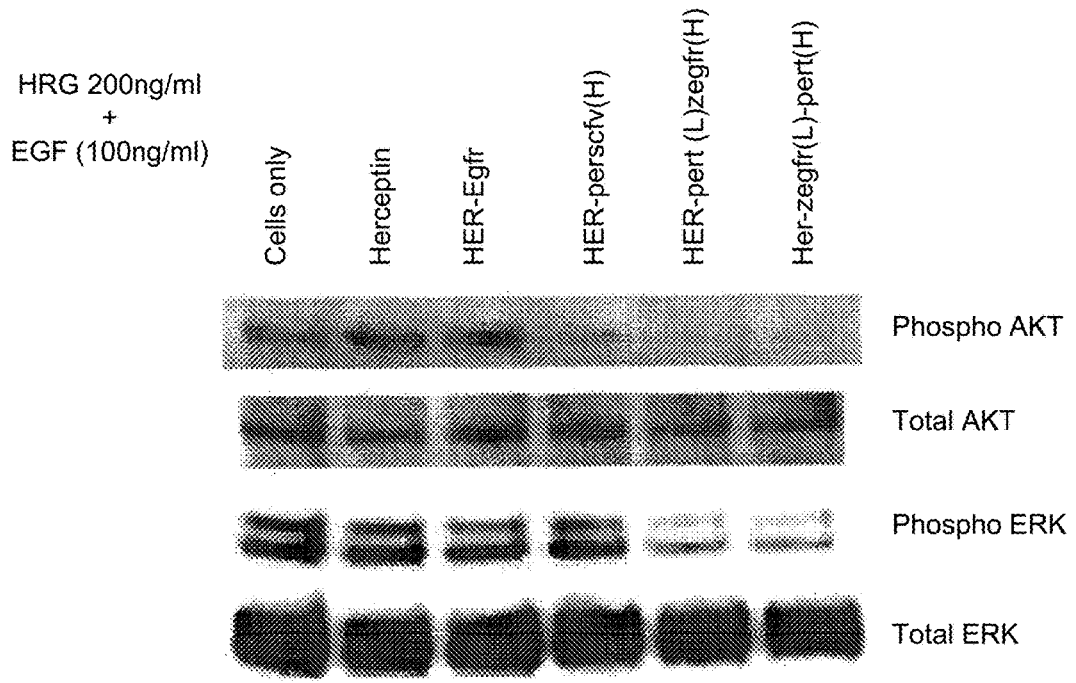

FIG. 33 shows inhibition of EGF and Heregulin-induced signaling in SK-BR3 cells by zybodies.

Figure 34A:
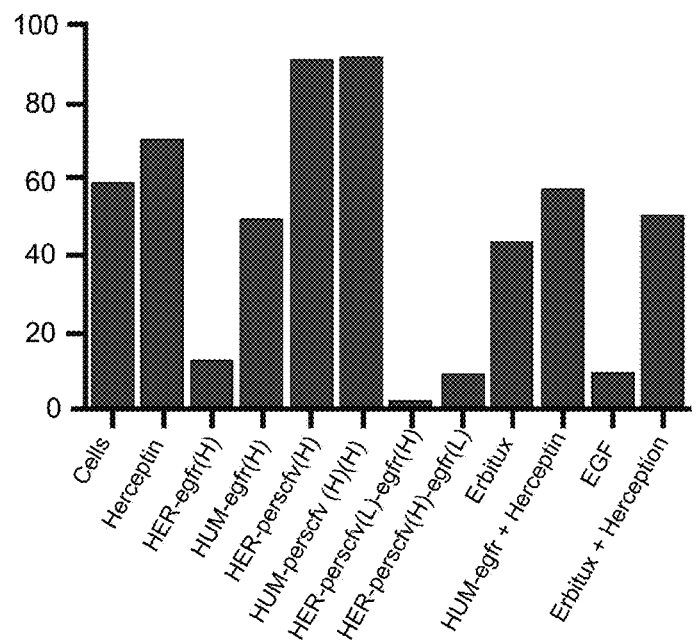
Figure 34B:
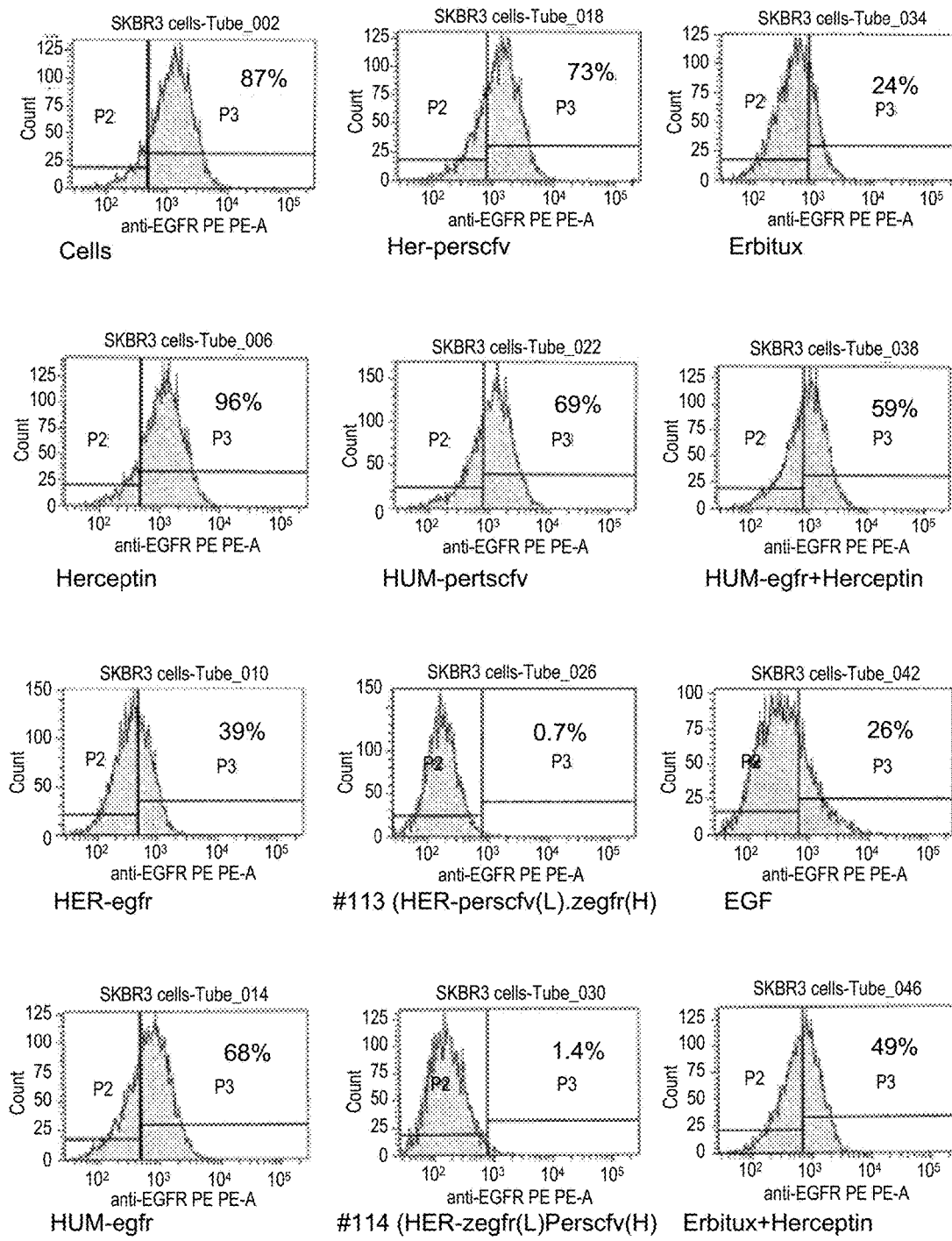

FIG. 34 shows a bar-graph (A) and flow-cytometry results (B) depicting the down-regulation of EGFR expression on SK-BR3 cells by zybodies.

Figure 35:

FIG. 35 shows down-regulation of EGFR in SKBR3 cells by zybodies.

FIG. 36 shows the cytotoxic effects of MRD-containing antibodies expressing different valencies of a DR5 agonizing MRD on three different mAb scaffolds using a cell viability assay. FIG. 36A, demonstrates that a tetravalent trastuzumab scaffold-based zybody demonstrates higher cytotoxic activity compared to corresponding bivalent zybodies. FIGS. 36B-C demonstrate that octavalent trastuzumab and palivizumab antibody scaffold-based zybodies containing eight copies of the DR5 MRD, demonstrate higher cytotoxic activity compared to their respective corresponding tetravalent zybodies. FIG. 36D and demonstrates that the multi-epitopic targeting of non-DR5 receptors (her2 and EGFR, respectively) enhances the cytotoxic activity of a tetra-valent DR5 targeting MRD. FIG. 36F demonstrates that the mab scaffold of the zybody (e.g., cetuximab (CET), trastuzumab (TRA), and palivizumab (PAL)) can influence the apparent cytotoxic potency of DR5 targeting MRDs.

Figure 37:
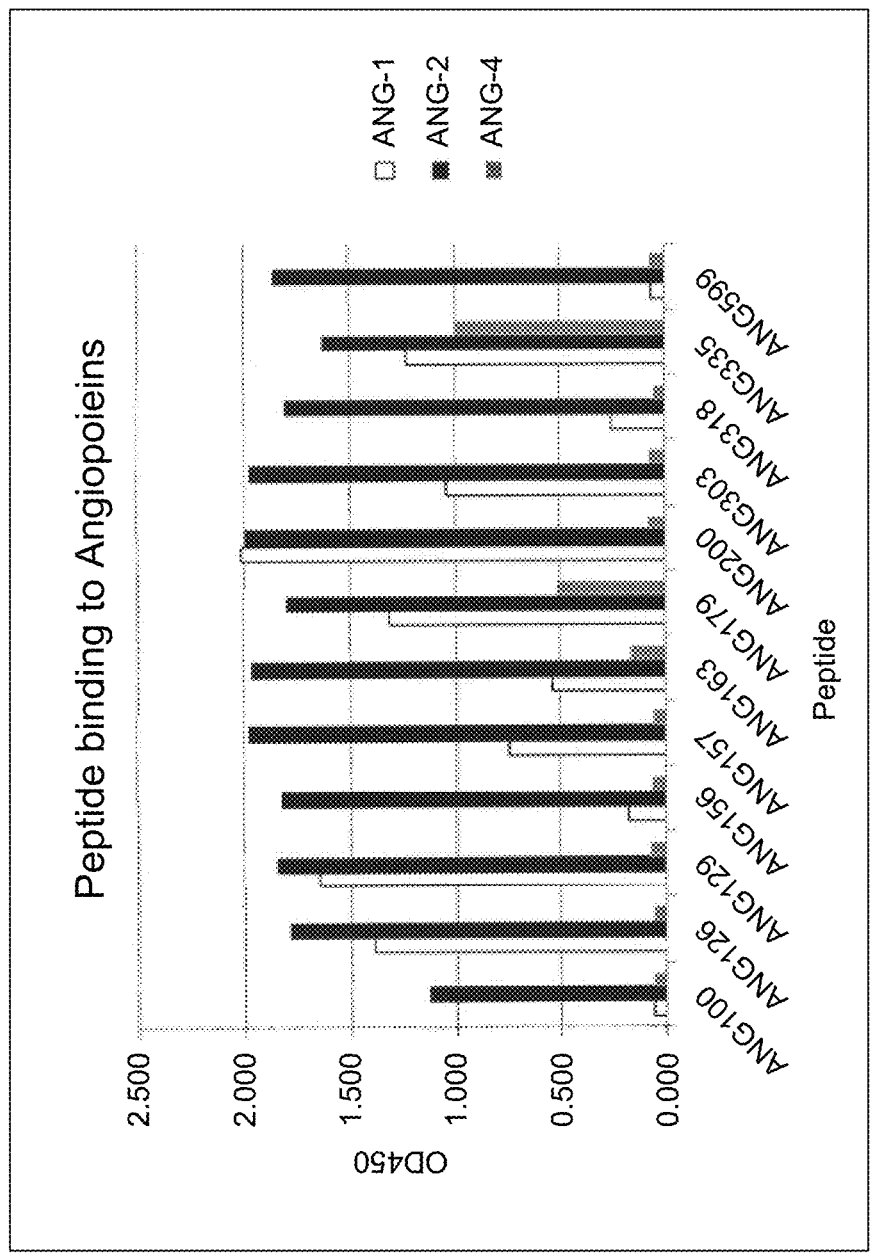

FIG. 37 demonstrates that Ang-binding peptides bind may differ in the relative binding to Ang1 and Ang4. The assayed peptides are ANG100 (SEQ ID NO:621), ANG126 (SEQ ID NO:232); ANG129 (SEQ ID NO:234); ANG156 (SEQ ID NO:255); ANG157 (SEQ ID NO:256); ANG163 (SEQ ID NO:261); ANG179 (SEQ ID NO:270); ANG200 (SEQ ID NO:628); ANG303 (SEQ ID NO:331); ANG318 (SEQ ID NO:625); ANG335 (SEQ ID NO:332); and ANG599 (SEQ ID NO:367).

DETAILED DESCRIPTION OF THE INVENTION

The following provides a description of multivalent and monovalent multispecific compositions (e.g., MRD-containing antibodies containing at least one modular recognition domain (MRD)). The linkage of one or more MRDs to an antibody results in a multi-specific molecule of the invention that retains structural and functional properties of traditional antibodies or Fc optimized antibodies and can readily be synthesized using conventional antibody expression systems and techniques. The antibody can be any suitable antigen-binding immunoglobulin, and the MRDs can be any suitable target-binding peptide. The MRDs can be operably linked to any location on the antibody, and the attachment can be direct or indirect (e.g., through a chemical or polypeptide linker). Compositions of antibodies comprising an MRD, methods of manufacturing antibodies comprising an MRD, and methods of using antibodies comprising MRDs are also described in the sections below.

The invention also encompasses MRDs, compositions comprising MRDs, polynucleotides encoding MRDs, methods of manufacturing MRDs, and methods of using the MRDs of the invention.

The section headings used herein are for organizational purposes only and are not to be construed as in any way limiting the subject matter described.

Standard techniques may be used for recombinant DNA molecule, protein, and antibody production, as well as for tissue culture and cell transformation. Enzymatic reactions and purification techniques are typically performed according to the manufacturer's specifications or as commonly accomplished in the art using conventional procedures such as those set forth in Harlow et al., Antibodies: A Laboratory Manual, (Cold Spring Harbor Laboratory Press, 2nd ed. 1988) and Sambrook et al., (Molecular Cloning: A Laboratory Manual. Cold Spring Harbor Laboratory Press, Cold Spring Harbor, N.Y. (1989)) (both herein incorporated by reference), or as described herein. Unless specific definitions are provided, the nomenclature utilized in connection with, and the laboratory procedures and techniques of analytical chemistry, synthetic organic chemistry, and medicinal and pharmaceutical chemistry described herein, are those known and used in the art. Standard techniques may be used for chemical syntheses, chemical analyses, pharmaceutical preparation, formulation, delivery, and treatment of patients.

I. Definitions

The terms "multivalent and monovalent multispecific complexes", "multivalent and multispecific complexes", "MRD-containing antibodies," "antibody-MRD molecules," "MRD-antibody molecules," "antibodies comprising an MRD" and "Zybodies" are used interchangeably herein and do not encompass a peptibody. Each of these terms may also be used herein to refer to a "complex" of the invention. Multivalent and monovalent multispecific complexes can contain MRDs, antibodies, cytoxic agents, and binding motifs in addition to MRDs that bind to one or more targets. For example, a multivalent and monovalent multispecific complex (e.g., an MRD-containing antibody) can contain a portion of, or a derivative of, a binding sequence contained in antibody (e.g., a single binding domain, a ScFv, a CDR region) and/or can also include a cytotoxic agent (e.g., a therapeutic agent). Such molecules are also described in U.S. Provisional Application No. 61/481,063, which is herein incorporated by reference in its entirety. The terms "multivalent and monovalent multispecific complex(es)" and "multivalent and monovalent multispecific complexes" as used herein therefore refer to compositions that are able to bind 2 or more targets and that contain one binding site and/or multiple binding sites for different epitopes. Thus, this term is intended to include complexes containing multiple binding sites for each different epitope bound by the complex, or alternatively, complexes that contain at least one single binding site for a different epitope. The different epitopes can be on the same or different targets. The targets of the multivalent and multi-specific complexes can be on the same or different cells. Multivalent and monovalent multispecific complexes can be multivalent and multispecific and can therefore bind two or more targets and have two or more binding sites for each of the targets bound by the complex. Multivalent and monovalent multispecific complexes can also have one (or more) single binding sites for one (or more) target(s) and multiple binding sites for other targets and accordingly, these complexes are monovalent (with respect to the single binding site(s)), multivalent and multispecific. Moreover, multivalent and monovalent multispecific complexes can be monovalent and multispecific and thus, only contain single binding sites for two or more different targets.

The term "multivalent and monovalent multispecific complex-drug complex" or "MRD-containing antibody-cytotoxic agent" as used herein, refers to a multivalent and monovalent multispecific complex containing one or more cytotoxic agents.

The term "cytotoxic agent" as used herein, includes any agent that is detrimental to cells including for example, substance that inhibits or prevents the function of cells and/or causes destruction of cells. The term is intended to include a chemotherapeutic agent, a drug moiety (e.g., a cytokine or prodrug), an antibiotic, a radioactive isotope, a chelating ligand (e.g., DOTA, DOTP, DOTMA, DTPA and TETA), a nucleolytic enzyme, a toxins such as a small molecule toxin or enzymatically active toxin of bacterial, fungal, plant or animal origin, including fragments and/or variants of these toxins. In particular embodiments, the cytotoxic agent is a member selected from: auristatin, dolostantin, MMAE, MMAF, a maytansinoid derivative (e.g., the DM1 (N(2')-deacetyl-N(2')-(3-mercapto-1-oxopropyl)-maytansine), DM3 (N(2')-deacetyl-N2-(4-mercapto-1-oxopentyl)-maytansine) and DM4 (N(2)-deacetyl-N2-(4-mercapto-4-methyl-1-oxopentyl)-maytansine).

The term "antibody" is used herein to refer to immunoglobulin molecules that are able to bind antigens through an antigen binding domain (i.e., antibody combining site). The term "antibody" includes polyclonal, oligoclonal (mixtures of antibodies), and monoclonal antibodies, chimeric, single chain, and humanized antibodies. The term "antibody" also includes human antibodies. In some embodiments, an antibody comprises at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains: CH1, CH2, and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxyl-terminus in the following order: FR1, CDR1, FR2, CDR2, FR3, CDR3, FR4. In other embodiments, the antibody is a homomeric heavy chain antibody (e.g., camelid antibodies) which lacks the first constant region domain (CH1) but retains an otherwise intact heavy chain and is able to bind antigens through an antigen binding domain. The variable regions of the heavy and light chains in the antibody-MRD fusions of the invention contain a functional binding domain that interacts with an antigen.

The term "monoclonal antibody" typically refers to a population of antibody molecules that contain only one species of antibody combining site capable of immunoreacting with a particular epitope. A monoclonal antibody thus typically displays a single binding affinity for any epitope with which it immunoreacts. As used herein, a "monoclonal antibody" may also contain an antibody molecule having a plurality of antibody combining sites (i.e., a plurality of variable domains), each immunospecific for a different epitope, e.g., a bispecific monoclonal antibody. Thus, as used herein, a "monoclonal antibody" refers to a homogeneous antibody population involved in the highly specific recognition and binding of one or two (in the case of a bispecific monoclonal antibody) antigenic determinants, or epitopes. This is in contrast to polyclonal antibodies that typically include different antibodies directed against different antigenic determinants. The term "monoclonal antibody" refers to such antibodies made in any number of manners including but not limited to by hybridoma, phage selection, recombinant expression, yeast, and transgenic animals.

A "dual-specific antibody" is used herein to refer to an immunoglobulin molecule that contains dual-variable-domain immunoglobulins, where the dual-variable-domain can be engineered from any two monoclonal antibodies.

The term "chimeric antibodies" refers to antibodies wherein the amino acid sequence of the immunoglobulin molecule is derived from two or more species. Typically, the variable region of both light and heavy chains corresponds to the variable region of antibodies derived from one species of mammals (e.g., mouse, rat, rabbit, etc.) with the desired specificity and/or affinity while the constant regions are homologous to the sequences in antibodies derived from another species (usually human) to avoid eliciting an immune response in that species.

The term "humanized antibody" refers to forms of non-human (e.g., murine) antibodies that are specific immunoglobulin chains, chimeric immunoglobulins, or fragments thereof that contain minimal non-human (e.g., murine) sequences. Typically, humanized antibodies are human immunoglobulins in which residues from the complementarity determining region (CDR) are replaced by residues from the CDR of a non-human species (e.g., mouse, rat, rabbit, hamster) that have the desired specificity and/or affinity (Jones et al., Nature, 321:522-525 (1986); Riechmann et al., Nature 332:323-327 (1988); Verhoeyen et al., Science 239:1534-1536 (1988)). In some instances, the Fv framework region (FR) residues of a human immunoglobulin are replaced with the corresponding residues in an antibody from a non-human species that has the desired specificity and/or affinity. The humanized antibody can be further modified by the substitution of additional residues either in the Fv framework region and/or within the replaced non-human residues to refine and optimize antibody specificity, affinity, and/or capability. In general, the humanized antibody will comprise substantially all of at least one, and typically two or three, variable domains containing all or substantially all of the CDR regions that correspond to the non-human immunoglobulin whereas all or substantially all of the FR regions are those of a human immunoglobulin consensus sequence. The humanized antibody can also comprise an immunoglobulin constant region or domain (Fc), typically that of a human immunoglobulin. Examples of methods used to generate humanized antibodies are described in U.S. Pat. No. 5,225,539, U.S. Pat. No. 4,816,567, Morrison, Science 229:1202 (1985); Oi et al., BioTechniques 4:214 (1986); Cabilly et al., Taniguchi et al., EP 171496; Morrison et al., EP 173494, WO86/01533; WO8702671; Boulianne et al., Nature 312:643 (1984); and Neuberger et al., Nature 314:268 (1985), each of which is herein incorporated by reference in its entirety.

As used herein, "human" antibodies include antibodies having the amino acid sequence of a human immunoglobulin or one or more human germlines and include antibodies isolated from human immunoglobulin libraries or from animals transgenic for one or more human immunoglobulins and that do not express endogenous immunoglobulins, as described infra and, for example in, U.S. Pat. No. 5,939,598 by Kucherlapati et al., A human antibody may still be considered "human" even if amino acid substitutions are made in the antibody. Examples of methods used to generate human antibodies are described in: Int. Appl. Publ. Nos. WO98/24893, WO92/01047, WO96/34096, and WO96/33735; European Pat. No. 0 598 877; U.S. Pat. Nos. 5,413,923, 5,625,126, 5,633,425, 5,569,825, 5,661,016, 5,545,806, 5,814,318, 5,885,793, 5,916,771, and 5,939,598; and Lonberg and Huszar, Int. Rev. Immunol. 13:65-93 (1995), which are herein incorporated by reference.

An "antibody combining site" is that structural portion of an antibody molecule comprised of heavy and light chain variable and hypervariable regions that specifically binds (immunoreacts with) an antigen. The term "immunoreact" in its various forms means specific binding between an antigenic determinant-containing molecule and a molecule containing an antibody combining site such as a whole antibody molecule or a portion thereof.

In naturally occurring antibodies, the six "complementarity determining regions" or "CDRs" present in each antigen binding domain are short, non-contiguous sequences of amino acids that are specifically positioned to form the antigen binding domain as the antibody assumes its three dimensional configuration in an aqueous environment. The remainder of the amino acids in the antigen binding domains, referred to as "framework" regions, show less inter-molecular variability. The framework regions largely adopt a β-sheet conformation and the CDRs form loops which connect, and in some cases form part of, the β-sheet structure. Thus, framework regions act to form a scaffold that provides for positioning the CDRs in correct orientation by inter-chain, non-covalent interactions. The antigen binding domain (i.e., antibody combining site) formed by the positioned CDRs defines a surface complementary to the epitope on the immunoreactive antigen. This complementary surface promotes the non-covalent binding of the antibody to its cognate epitope. The amino acids comprising the CDRs and the framework regions, respectively, can be readily identified for any given heavy or light chain variable region by one of ordinary skill in the art, since they have been precisely defined (see, "Sequences of Proteins of Immunological Interest," Kabat, E., et al., U.S. Department of Health and Human Services, (1983); and Chothia and Lesk, J. Mol. Biol. 196:901-917 (1987), which are herein incorporated by reference). "Humanized antibody" or "chimeric antibody" includes antibodies in which CDR sequences derived from the germline of another mammalian species, such as a mouse, have been grafted onto human framework sequences.

The terms "T lymphocyte," "T cell," "T cells," and "T cell population," are used interchangeably herein to refer to a cell or cells which display on their surface one or more antigens characteristic of T cells, for example, CD3 and CD11b. The term includes progeny of a T cell or T cell population. A "T lymphocyte" or "T cell" includes a cell which expresses CD3 on its cell surface and a T cell antigen receptor (TCR) capable of recognizing antigen when displayed on the surface of autologous cells, or any antigen-presenting matrix, together with one or more MHC molecules or, one or more non-classical MHC molecules. The term "T cells" may refer to any T cells, including for example, lymphocytes that are phenotypically $CD3^+$ i.e., express CD3 on the cell surface.

As used herein, CD3, is used to refer individually or collectively to a molecule expressed as part of the T cell receptor and having a meaning as typically ascribed to it in the art. In humans, the term CD3 encompasses all known CD3 subunits, for example CD3 delta, CD3 epsilon, CD3 gamma, and CD3 zeta (TCR zeta), as well as CD3 alpha (TCR alpha), and CD3 beta (TCR beta) in individual or independently combined form.

The term "peptibody" refers to a peptide or polypeptide which comprises less than a complete, intact antibody. A peptibody can be an antibody Fc domain attached to at least one peptide. A peptibody does not include antibody variable regions, an antibody combining site, CH1 domains, or Ig light chain constant region domains.

The term "naturally occurring" when used in connection with biological materials such as a nucleic acid molecules, polypeptides, host cells, and the like refers to those which are found in nature and not modified by a human being.

The term "domain" as used herein refers to a part of a molecule or structure that shares common physical or chemical features, for example hydrophobic, polar, globular, helical domains or properties, e.g., a protein binding domain, a DNA binding domain or an ATP binding domain. Domains can be identified by their homology to conserved structural or functional motifs.

A "conservative amino acid substitution" is one in which one amino acid residue is replaced with another amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). For example, substitution of a phenylalanine for a tyrosine is a conservative substitution. In some embodiments, conservative substitutions in the sequences of the polypeptides and antibodies of the invention do not abrogate the binding of the polypeptide or antibody containing the amino acid sequence to the antigen(s) to which the polypeptide or antibody binds. Methods of identifying nucleotide and amino acid conservative substitutions and non-conservative substitutions which do not eliminate polypeptide or antigen binding are well-known in the art (see, e.g., Brummell et al., Biochem. 32:1180-1187 (1993); Kobayashi et al., Protein Eng. 12(10):879-884 (1999); and Burks et al., Proc. Natl. Acad. Sci. USA 94:412-417 (1997)).

A "modular recognition domain" (MRD) or "target binding peptide" is a molecule, such as a protein, glycoprotein and the like, that can specifically (non-randomly) bind to a target molecule. The amino acid sequence of a MRD can typically tolerate some degree of variability and still retain a degree of capacity to bind the target molecule. Furthermore, changes in the sequence can result in changes in the binding specificity and in the binding constant between a preselected target molecule and the binding site. In one embodiment, the MRD is an agonist of the target it binds. An MRD agonist refers to a MRD that in some way increases or enhances the biological activity of the MRD's target protein or has biological activity comparable to a known agonist of the MRD's target protein. In another embodiment, the MRD is an antagonist of the target it binds. An MRD antagonist refers to an MRD that blocks or in some way interferes with the biological activity of the MRD's target protein or has biological activity comparable to a known antagonist or inhibitor of the MRD's target protein.

"Cell surface receptor" refers to molecules and complexes of molecules capable of receiving a signal and the transmission of such a signal across the plasma membrane of a cell. An example of a cell surface receptor of the present invention is an activated integrin receptor, for example, an activated αvβ3 integrin receptor on a metastatic cell. As used herein, "cell surface receptor" also includes a molecule expressed on a cell surface that is capable of being bound by an MRD containing antibody of the invention.

As used herein, a "target binding site" or "target site" is any known, or yet to be defined, amino acid sequence having the ability to selectively bind a preselected agent. Exemplary reference target sites are derived from the RGD-dependent integrin ligands, namely fibronectin, fibrinogen, vitronectin, von Willebrand factor and the like, from cellular receptors such as ErbB2, VEGF, vascular homing peptide or angiogenic cytokines, from protein hormones receptors such as insulin-like growth factor-I receptor, epidermal growth factor receptor and the like, and from tumor antigens.

The term "epitope" or "antigenic determinant" are used interchangeably herein and refer to that portion of any molecule capable of being recognized and specifically bound by a particular binding agent (e.g., an antibody or an MRD). When the recognized molecule is a polypeptide, epitopes can be formed from contiguous amino acids and noncontiguous amino acids and/or other chemically active surface groups of molecules (such as carbohydrates) juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3, and more usually, at least 5 or 8-10 amino acids in a unique spatial conformation.

An antibody, MRD, antibody-containing MRD, or other molecule is said to "competitively inhibit" binding of a reference molecule to a given epitope if it binds to that epitope to the extent that it blocks, to some degree, binding of the reference molecule to the epitope. Competitive inhibition may be determined by any method known in the art, for example, competition ELISA assays. As used herein, an antibody, MRD, antibody-containing MRD, or other molecule may be said to competitively inhibit binding of the reference molecule to a given epitope, for example, by at least 90%, at least 80%, at least 70%, at least 60%, or at least 50%.

The term "protein" is defined as a biological polymer comprising units derived from amino acids linked via peptide bonds; a protein can be composed of two or more chains.

A "fusion polypeptide" is a polypeptide comprised of at least two polypeptides and optionally a linking sequence to operatively link the two polypeptides into one continuous polypeptide. The two polypeptides linked in a fusion polypeptide are typically derived from two independent sources, and therefore a fusion polypeptide comprises two linked polypeptides not normally found linked in nature. The two polypeptides may be operably attached directly by a peptide bond or may be linked indirectly through a linker described herein or otherwise known in the art.

The term "operably linked," as used herein, indicates that two molecules are attached so as to each retain functional activity. Two molecules are "operably linked" whether they are attached directly (e.g., a fusion protein) or indirectly (e.g., via a linker).

The term "linker" refers to a peptide located between the antibody and the MRD or between two MRDs. Linkers can have from about 1 to 20 amino acids, about 2 to 20 amino acids, or about 4 to 15 amino acids. One or more of these amino acids may be glycosylated, as is well understood by those in the art. In one embodiment, the 1 to 20 amino acids are selected from glycine, alanine, proline, asparagine, glutamine, and lysine. In another embodiment, a linker is made up of a majority of amino acids that are sterically unhindered, such as glycine and alanine Thus, in some embodiments, the linker is selected from polyglycines (such as $(Gly)_5$, and $(Gly)_8$), poly(Gly-Ala), and polyalanines. The linker can also be a non-peptide linker such as an alkyl linker, or a PEG linker. For example, alkyl linkers such as —NH—$(CH_2)s$-C(O)—, wherein s=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc. An exemplary non-peptide linker is a PEG linker. In certain embodiments, the PEG linker has a molecular weight of about 100 to 5000 kDa, or about 100 to 500 kDa. The peptide linkers may be altered to form derivatives. In some embodiments, the linker is a non-peptide linker such as an alkyl linker, or a PEG linker. In further embodiments, the linker is a "cleavable linker" facilitating release of an MRD or cytotoxic agent within a cell or in the proximity of the cell.

"Target cell" refers to any cell in a subject (e.g., a human or animal) that can be targeted by a multispecific and multivalent composition (e.g., an antibody-containing MRD) or MRD of the invention. The target cell can be a cell expressing or overexpressing the target binding site, such as an activated integrin receptor.

The term "immune response" refers to the action of, for example, lymphocytes, antigen presenting cells, phagocytic cells, granulocytes, and soluble macromolecules produced by the above cells or the liver (including antibodies, cytokines, and complement) that results in selective damage to, destruction of, or elimination from the human body of invading pathogens, cells, or tissues infected with pathogens, cancerous cells, or, in cases of autoimmunity or pathological inflammation, normal human cells or tissues.

As used herein, the term "effector cell" refers to an immune cell which is involved in the effector phase of an immune response, as opposed to the cognitive and activation phases of an immune response. Exemplary immune cells include a cell of a myeloid or lymphoid origin, e.g., lymphocytes (e.g., B cells and T cells including cytolytic T cells (CTLs)), killer cells, natural killer cells, macrophages, monocytes, eosinophils, neutrophils, polymorphonuclear cells, granulocytes, mast cells, and basophils). Some effector cells express specific Fc receptors and carry out specific immune functions. In certain embodiments, an effector cell is capable of inducing antibody-dependent cell-mediated cytotoxicity (ADCC), e.g., a neutrophil capable of inducing ADCC. For example, monocytes and macrophages, which express FcR, are involved in specific killing of target cells and presenting antigens to other components of the immune system, or binding to cells that present antigens. In other embodiments, an effector cell can phagocytose a target antigen or target cell. The expression of a particular FcR on an effector cell can be regulated by humoral factors such as cytokines. For example, expression of Fc alpha RI has been found to be up-regulated by G-CSF or GM-CSF. This enhanced expression increases the effector function of Fc alpha RI-bearing cells against targets. Exemplary functions of an effector cell include the phagocytosing or lysing of a target antigen or a target cell.

"Target cell" refers to any cell or pathogen whose elimination would be beneficial in a patient (e.g., a human or animal) and that can be targeted by a composition (e.g., antibody) of the invention.

"Patient," "subject," "animal" or "mammal" are used interchangeably and refer to mammals such as human patients and non-human primates, as well as experimental animals such as rabbits, rats, and mice, and other animals. Animals include all vertebrates, e.g., mammals and non-mammals, such as sheep, dogs, cows, chickens, amphibians, and reptiles. In some embodiments, the patient is a human.

"Treating" or "treatment" includes the administration of the antibody comprising an MRD of the present invention to prevent or delay the onset of the symptoms, complications, or biochemical indicia of a disease, condition, or disorder, alleviating the symptoms or arresting or inhibiting further development of the disease, condition, or disorder. Treatment can be prophylactic (to prevent or delay the onset of the disease, or to prevent the manifestation of clinical or subclinical symptoms thereof) or therapeutic suppression or alleviation of symptoms after the manifestation of the disease, condition, or disorder. Treatment can be with the antibody-MRD composition alone, the MRD alone, or in combination of either with one or more additional therapeutic agents.

As used herein, the terms "pharmaceutically acceptable," or "physiologically tolerable" and grammatical variations thereof, as they refer to compositions, carriers, diluents and reagents, are used interchangeably and represent that the materials are capable of administration to or upon a human without the production of therapeutically prohibitive undesirable physiological effects such as nausea, dizziness, gastric upset and the like.

"Modulate" or "modulates" means adjustment or regulation of amplitude, frequency, degree, or activity. In another related aspect, such modulation may be positively modulated (e.g., an increase in frequency, degree, or activity) or negatively modulated (e.g., a decrease in frequency, degree, or activity).

"Cancer," "tumor," or "malignancy" are used as synonymous terms and refer to any of a number of diseases that are characterized by uncontrolled, abnormal proliferation of cells, the ability of affected cells to spread locally or through the bloodstream and lymphatic system to other parts of the body (metastasize) as well as any of a number of characteristic structural and/or molecular features. A "cancerous tumor," or "malignant cell" is understood as a cell having specific structural properties, lacking differentiation and being capable of invasion and metastasis. Examples of cancers that may be treated using the antibody-MRD fusions of the invention include solid tumors and hematologic cancers. Additional, examples of cancers that may be treated using the antibody-MRD fusions of the invention include breast, lung, brain, bone, liver, kidney, colon, head and neck, ovarian, hematopoietic (e.g., leukemia), and prostate cancer. Further examples of cancer that may be treated using the multivalent and multispecific compositions (e.g., MRD-containing antibodies) include, but are not limited to, carcinoma, lymphoma, blastoma, sarcoma, and leukemia. More particular examples of such cancers include squamous cell cancer, small-cell lung cancer, non-small cell lung cancer, adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, liver cancer, prostate cancer, vulval cancer, thyroid cancer, hepatic carcinoma and various types of head and neck cancers. Other types of cancer and tumors that may be treated using multivalent and multispecific compositions (e.g., MRD-containing antibodies) are described herein or otherwise known in the art.

An "effective amount" of an antibody, MRD, or MRD-containing antibody as disclosed herein is an amount sufficient to carry out a specifically stated purpose such as to bring about an observable change in the level of one or more biological activities related to the target to which the antibody, MRD, or MRD-containing antibody binds. In certain embodiments, the change increases the level of target activity. In other embodiments, the change decreases the level of target activity. An "effective amount" can be determined empirically and in a routine manner, in relation to the stated purpose.

The term "therapeutically effective amount" refers to an amount of an antibody, MRD, MRD-containing antibody, other multivalent and multispecific drug of the invention, or other drug effective to "treat" a disease or disorder in a patient or mammal. In the case of cancer, the therapeutically effective amount of the drug can reduce angiogenesis and neovascularization; reduce the number of cancer cells; reduce the tumor size; inhibit (i.e., slow to some extent or stop) cancer cell infiltration into peripheral organs; inhibit (i.e., slow to some extent or stop) tumor metastasis; inhibit, to some extent, tumor growth or tumor incidence; stimulate immune responses against cancer cells and/or relieve to some extent one or more of the symptoms associated with the cancer. See the definition herein of "treating". A "therapeutically effective amount" also may refer to an amount effective, at dosages and for periods of time necessary, to achieve a desired therapeutic result. A therapeutically effective amount of a composition of the invention may vary according to factors such as the disease state, age, sex, and weight of the individual, and the ability of the composition to elicit a desired response in the individual. A therapeutically effective amount is also one in which any toxic or detrimental effects of the therapeutic composition are outweighed by the therapeutically beneficial effects.

To the extent the drug can prevent growth and/or kill existing cancer cells, it can be cytostatic and/or cytotoxic. A "prophylactically effective amount" refers to an amount effective, at dosages and for periods of time necessary, to achieve the desired prophylactic result. Typically, but not necessarily, since a prophylactic dose is used in subjects (patients) prior to or at an earlier stage of disease, the prophylactically effective amount will be less than the therapeutically effective amount.

Where embodiments of the invention are described in terms of a Markush group or other grouping of alternatives, the present invention encompasses not only the entire group listed as a whole, but also each member of the group individually and all possible subgroups of the main group, and also the main group absent one or more of the group members. The present invention also envisages the explicit exclusion of one or more of any of the group members in the disclosed and/or claimed invention.

II. Modular Recognition Domains (MRDs)

The present invention describes an approach based on the adaptation of target binding peptides or modular recognition domains (MRDs) as fusions to catalytic or non-catalytic antibodies.

In certain embodiments, where the antibody component of the MRD-antibody fusion is a catalytic antibody, the MRD-antibody fusions provide for effective targeting to tumor cells or soluble molecules while leaving the prodrug activation capability of the catalytic antibody intact. MRDs can also extend the binding capacity of non-catalytic antibodies providing for an effective approach to extend the binding functionality of antibodies, particularly for therapeutic purposes.

One aspect of the present invention relates to development of a full-length antibody comprising at least one modular recognition domain (MRD). In another non-exclusive embodiment, the full-length antibody comprises more than one MRD, wherein the MRDs have the same or different specificities. In addition, a single MRD may be comprised of a tandem repeat of the same or different amino acid sequence that can allow for the binding of a single MRD to multiple targets and/or to a repeating epitope on a given target.

The interaction between a protein ligand and its target receptor site often takes place at a relatively large interface. However, only a few key residues at the interface contribute to most of the binding. The MRDs can mimic ligand binding. In certain embodiments, the MRD can mimic the biological activity of a ligand (an agonist MRD) or through competitive binding inhibit the bioactivity of the ligand (an antagonist MRD). MRDs in multivalent and multispecific compositions (e.g., MRD-containing antibodies) can also affect targets in other ways, e.g., by neutralizing, blocking, stabilizing, aggregating, or crosslinking the MRD target.

It is contemplated that MRDs of the present invention will generally contain a peptide sequence that binds to target sites of interests and have a length of about 2 to 150 amino acids, about 2 to 125 amino acids, about 2 to 100 amino acids, about 2 to 90 amino acids, about 2 to 80 amino acids, about 2 to 70 amino acids, about 2 to 60 amino acids, about 2 to 50 amino acids, about 2 to 40 amino acids, about 2 to 30 amino acids, or about 2 to 20 amino acids. It is also contemplated that MRDs have a length of about 10 to 150 amino acids, about 10 to 125 amino acids, about 10 to 100 amino acids, about 10 to 90 amino acids, about 10 to 80 amino acids, about 10 to 70 amino acids, about 10 to 60 amino acids, about 10 to 50 amino acids, about 10 to 40 amino acids, about 10 to 30 amino acids, or about 10 to 20 amino acids. It is further contemplated that MRDs have a length of about 20 to 150 amino acids, about 20 to 125 amino acids, about 20 to 100 amino acids, about 20 to 90 amino acids, about 20 to 80 amino acids, about 20 to 70 amino acids, about 20 to 60 amino acids, about 20 to 50 amino acids, about 20 to 40 amino acids, or about 20 to 30 amino acids. In certain embodiments, the MRDs have a length of about 2 to 60 amino acids. In other embodiments, the MRDs have a length of about 10 to 60 amino acids. In other embodiments, the MRDs have a length of about 10 to 50 amino acids. In additional embodiments, the MRDs have a length of about 10 to 40 amino acids. In additional embodiments, the MRDs have a length of about 10 to 30 amino acids.

In some embodiments, one or more of the MRD components of the multivalent and multispecific compositions (e.g., MRD-containing antibodies) have a dissociation constant or Kd of less than $5\times10^{-3}$ M, $10^{-3}$ M, $5\times10^{-4}$ M, $10^{-4}$ M, $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, or $10^{-15}$ M. In one embodiment, one or more of the MRD components of the multivalent and multispecific compositions (e.g., MRD-containing antibodies) have a dissociation constant or Kd less than $5\times10^{-5}$ M. In another embodiment, one or more of the MRD components of the multivalent and multispecific compositions (e.g., MRD-containing antibodies) have a dissociation constant or Kd less than $5\times10^{-8}$ M. In another embodiment, one or more of the MRD components of the multivalent and multispecific compositions (e.g., MRD-containing antibodies) have a dissociation constant or Kd less than $5 \times 10^{-9}$ M. In another embodiment, one or more of the MRD components of the multivalent and multispecific compositions (e.g., MRD-containing antibodies) have a dissociation constant or Kd less than $5 \times 10^{-10}$ M. In another embodiment, one or more of the MRD components of the multivalent and multispecific compositions (e.g., MRD-containing antibodies) have a dissociation constant or Kd less than $5 \times 10^{-11}$ M. In another embodiment, one or more of the MRD components of the multivalent and multispecific compositions (e.g., MRD-containing antibodies) have a dissociation constant or Kd less than $5 \times 10^{-12}$ M.

In specific embodiments, one or more of the MRD components of the multivalent and multispecific compositions (e.g., MRD-containing antibodies) bind their targets with an off rate ($k_{off}$) of less than $5 \times 10^{-2}$ sec$^{-1}$, $10^{-2}$ sec$^{-1}$, $5 \times 10^{-3}$ sec$^{-1}$, or $10^{-3}$ sec$^{-1}$. More preferably, one or more of the MRD components of the multivalent and multispecific compositions (e.g., MRD-containing antibodies) bind their targets with an off rate ($k_{off}$) of less than $5 \times 10^{-4}$ sec$^{-1}$, $10^{-4}$ sec$^{-1}$, $5 \times 10^{-5}$ sec$^{-1}$, or $10^{-5}$ sec$^{-1}$, $5 \times 10^{-6}$ sec$^{-1}$, $10^{-6}$ sec$^{-1}$, $5 \times 10^{-7}$ sec$^{-1}$, or $10^{-7}$ sec$^{-1}$.

In other specific embodiments, one or more of the MRD components of the multivalent and multispecific compositions (e.g., MRD-containing antibodies) bind their targets with an on rate ($k_{on}$) of greater than $10^3$ M$^{-1}$ sec$^{-1}$, $5 \times 10^3$ M$^{-1}$ sec$^{-1}$, $10^4$ M$^{-1}$ sec$^{-1}$, or $5 \times 10^4$ M$^{-1}$ sec$^{-1}$. More preferably, one or more of the MRD components of the multivalent and multispecific compositions (e.g., MRD-containing antibodies) bind their targets with an on rate ($k_{on}$) of greater than $10^5$ M$^{-1}$ sec$^{-1}$, $5 \times 10^5$ M$^{-1}$ sec$^{-1}$, $10^6$ M$^{-1}$ sec$^{-1}$, or $5 \times 10^6$ M$^{-1}$ sec$^{-1}$, or $10^7$ M$^{-1}$ sec$^{-1}$.

In some embodiments, the MRDs are affibodies. Affibodies represent a class of affinity proteins based on a 58-amino acid residue protein domain derived from one of the IgG-binding domains of staphylococcal protein A. This three helix bundle domain has been used as a scaffold for the construction of combinatorial phagemid libraries, from which affibody variants that bind a desired target molecule, such as one or more of the targets disclosed herein, can routinely be selected using phage display technology (see, e.g., Nord et al., Nat. Biotechnol. 15:772-7 (1997), and Ronmark et al., A, Eur. J. Biochem. 2002; 269:2647-55). Further details of Affibodies and methods of production thereof are provided by reference to U.S. Pat. No. 5,831,012, which is herein incorporated by reference in its entirety.

In other embodiments, an MRD of the invention (e.g., an MRD on an MRD-containing antibody) contains one or more amino acid residues or sequences of amino acid residues (including derivatives, analogs, and mimetics thereof) that are preferentially targeted by chemistries or other processes that covalently or non-covalently link a molecular entity to the MRD, as compared to, the MRD without the preferentially targeted sequences or the antibody component of the MRD-containing antibody. For example, in some embodiments, the amino acid sequence of the MRD contains one or more residues having a reactive side chain (e.g., cysteine or lysine) that allows for selective or preferential linkage of the MRD to cytotoxic agents (e.g., drug and prodrug conjugates, toxins, and bioactive ligands) or imaging agents.

The use of these "linking" MRDs to arm an MRD-comprising antibody with a "payload" overcomes many of the issues associated with antibody destabilization and reduction in antibody activity that have frequently been observed using conventional methods for generating immunotoxins. The "payload" component of an MRD-comprising antibody complex of the invention can be any composition that confers a beneficial therapeutic, diagnostic, or prognostic effect, or that provide an advantage in manufacturing, purifying or formulating an MRD-containing antibody. In some embodiments, the payload is a chemotherapeutic drug, or a prodrug, such as, doxorubicin or a maytansinoid-like drug. In additional embodiments, the payload is another MRD, a toxin, a chemotherapeutic drug, a catalytic enzyme, a prodrug, a radioactive nuclide, a chelator (e.g., for the attachment of lanthanides) or another component of the multivalent and multispecific compositions of the invention as described herein.

In nonexclusive embodiments, the MRD does not contain an antigen binding domain, or another antibody domain such as a constant region, a variable region, a complementarity determining region (CDR), a framework region, an Fc domain, or a hinge region. In one non-exclusive embodiment, the MRD does not contain an antigen binding domain. In another non-exclusive embodiment, the MRD does not contain three CDRs. In another non-exclusive embodiment, the MRD does not contain CDR1 and CDR2. In yet another non-exclusive embodiment, the MRD does not contain CDR1. In one nonexclusive embodiment, the MRD is not derived from a natural cellular ligand. In another nonexclusive embodiment, the MRD is not a radioisotope. In another nonexclusive embodiment, the MRD is not a protein expression marker such as glutathione S-transferase (GST), His-tag, Flag, hemagglutinin (HA), MYC or a fluorescent protein (e.g., GFP or RFP). In another nonexclusive embodiment, the MRD does not bind serum albumin. In an additional nonexclusive embodiment, the MRD is not a small molecule that is a cytotoxin. It yet another nonexclusive embodiment, the MRD does not have enzymatic activity. In another non-exclusive embodiment, the MRD has a therapeutic effect when administered alone and/or when fused to an Fc in a patient or animal model. In another non-exclusive embodiment, the MRD has a therapeutic effect when repeatedly administered alone and/or when fused to an Fc in a patient or animal model (e.g., 3 or more times over the course of at least six months).

In some embodiments, the MRD is conformationally constrained. In other embodiments, the MRD is not conformationally constrained. In some embodiments, the MRD contains one cysteine residue. The cysteine residue in the MRD can form an interchain bond (e.g., between cysteines within the same MRD, different peptide linked MRDs, and an MRD and a peptide linked immunoglobulin). In some embodiments, the MRD(s) participating in the interchain bond is/are associated with a single core target-binding domain. In other embodiments, the MRD(s) participating in the interchain bond is/are associated with multiple core target-binding domains. In an alternative embodiment, the cysteine residue in the MRD can form an interchain bond (e.g., between cysteines of non-peptide linked MRDs or an MRD and an immunoglobulin that are not linked by a peptide bind). In some embodiments, the MRD(s) associated with the interchain bond is/are associated with a single core target-binding domain (i.e., 2 MRDs located on different polypeptide chains form one or more interchain bonds and collectively form one target binding site). Thus, for example, the invention encompasses MRD-containing antibodies wherein MRDs located on the carboxyl terminus of the heavy chain interact (e.g., via disulfide bond) so as to form a single target binding site. In other embodiments, the MRD(s) associated with the interchain bond is/are associated with multiple core target-binding domains. Alternatively, as discussed herein, the MRD can contain one or more cysteine residues (or other residue having a reactive side chain (e.g., lysine)) that allows for selective or preferential linkage of the MRD to a cytotoxic agent.

In some embodiments, the MRD contains two cysteine residues outside the core target-binding domain. In some embodiments, the MRD contains two cysteine residues located within the core target-binding domain at each end of the target-binding domain. In some embodiments, a first cysteine is located near the terminus of the molecule (i.e. at the C-terminus of an MRD on the C-terminus of a linker or antibody chain or at the N-terminus of an MRD on the N-terminus of a linker or antibody chain). Thus, in some embodiments, a first cysteine is located within one amino acid, within two amino acids, within three amino acids, within four amino acids, within five amino acids, or within six amino acids of the terminus of the molecule. In some embodiments, a second cysteine is located near the MRD fusion location (i.e. at the N-terminus of an MRD on the C-terminus of a linker or antibody chain or at the C-terminus of an MRD on the N-terminus of a linker or antibody chain). Thus, in some embodiments, a second cysteine is located within one amino acid, within two amino acids, within three amino acids, within four amino acids, within five amino acids, within 10 amino acids, or within 15 amino acids from the MRD fusion.

In some embodiments, the MRD is capped with stable residues. In some embodiments, the MRD is disulfide capped. In some embodiments, the MRD does not contain cleavage sites.

In some embodiments, the MRD has been selected to not contain known potential human T-cell epitopes.

In some particular embodiments, the MRD has a particular hydrophobicity. For example, the hydrophobicity of MRDs can be compared on the basis of retention times determined using hydrophobic interaction chromatography or reverse phase liquid chromatography.

The MRD target can be any molecule that it is desirable for an MRD-containing antibody to interact with. For example, the MRD target can be a soluble factor or a transmembrane protein, such as a cell surface receptor. The MRD target can also be an extracellular component or an intracellular component. In certain non-exclusive embodiments, the MRD target is a factor that regulates cell proliferation, differentiation, or survival. In other nonexclusive embodiments, the MRD target is a cytokine. In another nonexclusive embodiment, the MRD target is a factor that regulates angiogenesis. In another nonexclusive embodiment, the MRD target is a factor that regulates cellular adhesion and/or cell-cell interaction. In certain non-exclusive embodiments, the MRD target is a cell signaling molecule. In another nonexclusive embodiment, the MRD target is a factor that regulates one or more immune responses, such as, autoimmunity, inflammation and immune responses against cancer cells. In another nonexclusive embodiment, the MRD target is a factor that regulates cellular adhesion and/or cell-cell interaction. In an additional nonexclusive embodiment, the MRD target is a cell signaling molecule. In another embodiment, an MRD can bind a target that is itself an MRD. The ability of MRDs to bind a target and block, increase, or interfere with the biological activity of the MRD target can be determined using or routinely modifying assays, bioassays, and/or animal models known in the art for evaluating such activity.

The MRDs are able to bind their respective target when the MRDs are attached to an antibody. In some embodiments, the MRD is able to bind its target when not attached to an antibody. In some embodiments, the MRD is a target agonist. In other embodiments, the MRD is a target antagonist. In certain embodiments, the MRD can be used to localize an MRD-containing antibody to an area where the MRD target is located.

The sequence of the MRD can be determined several ways. For example, MRD sequences can be derived from natural ligands or known sequences that bind to a specific target binding site. Additionally, phage display technologies have emerged as a powerful method in identifying peptides which bind to target receptors and ligands. In peptide phage display libraries, naturally occurring and non-naturally occurring (e.g., random peptide) sequences can be displayed by fusion with coat proteins of filamentous phage. The methods for elucidating binding sites on polypeptides using phage display vectors has been previously described, in particular in WO94/18221, which is herein incorporated by reference. The methods generally involve the use of a filamentous phage (phagemid) surface expression vector system for cloning and expressing polypeptides that bind to the pre-selected target site of interest.

The methods of the present invention for preparing MRDs include the use of phage display vectors for their particular advantage of providing a means to screen a very large population of expressed display proteins and thereby locate one or more specific clones that code for a desired target binding reactivity. The ability of the polypeptides encoded by the clones to bind a target and/or alter the biological activity of the target can be determined using or routinely modifying assays and other methodologies described herein or otherwise known in the art. For example, phage display technology can be used to identify and improve the binding properties of MRDs. See, e.g., Scott et al., Science 249:386 (1990); Devlin et al., Science 249:404 (1990); U.S. Pat. Nos. 5,223,409, 5,733,731, 5,498,530, 5,432,018, 5,338,665, 5,922,545; and Int. Appl. Publ. Nos. WO96/40987 and WO98/15833; which are herein incorporated by reference. In peptide phage display libraries, natural and/or non-naturally occurring peptide sequences can be displayed by fusion with coat proteins of filamentous phage. The displayed peptides can be affinity-eluted against a target of interest if desired. The retained phage may be enriched by successive rounds of affinity purification and repropagation. The best binding peptides may be sequenced to identify key residues within one or more structurally related families of peptides. See, e.g., Cwirla et al., Science 276:1696-9 (1997), in which two distinct families were identified. The peptide sequences may also suggest which residues may be safely replaced by alanine scanning or by mutagenesis at the DNA level. Mutagenesis libraries may be created and screened to further optimize the sequence of the best binders. Lowman, Ann. Rev. Biophys. Biomol. Struct. 26:401-424 (1997).

Structural analysis of protein-protein interaction may also be used to suggest peptides that mimic the binding activity of large protein ligands. In such an analysis, the crystal structure may suggest the identity and relative orientation of critical residues of the large protein ligand, from which a peptide such as an MRD may be designed. See, e.g., Takasaki et al., Nature Biotech. 15:1266-1270 (1997). These analytical methods may also be used to investigate the interaction between a target and an MRD selected by phage display, which can suggest further modification of the MRDs to increase binding affinity.

Other methods known in the art can be used to identify MRDs. For example, a peptide library can be fused to the carboxyl terminus of the lac repressor and expressed in *E. coli*. Another *E. coli*-based method allows display on the cell's outer membrane by fusion with a peptidoglycan-associated lipoprotein (PAL). These and related methods are collectively referred to as "*E. coli* display." In another method, translation of random RNA is halted prior to ribosome release, resulting in a library of polypeptides with their associated RNA still attached. This and related methods are collectively referred to as "ribosome display." Other known methods employ chemical linkage of peptides to RNA. See, for example, Roberts and Szostak, Proc. Natl. Acad. Sci. USA 94:12297-12303 (1997). This and related methods are collectively referred to as "RNA-peptide screening, RNA display and mRNA display." Chemically derived peptide libraries have been developed in which peptides are immobilized on stable, non-biological materials, such as polyethylene rods or solvent-permeable resins. Another chemically derived peptide library uses photolithography to scan peptides immobilized on glass slides. These and related methods are collectively referred to as "chemical-peptide screening." Chemical-peptide screening may be advantageous in that it allows use of D-amino acids and other unnatural analogues, as well as non-peptide elements. Both biological and chemical methods are reviewed in Wells and Lowman, Curr. Opin. Biotechnol. 3:355-362 (1992). Furthermore, constrained libraries, linear libraries, and/or focused libraries (comprised of structurally related domains that share significant primary sequence homology) can be used to identify, characterize, and modify MRDs An improved MRD that specifically binds a desired target can also be prepared based on a known MRD sequence. For example, at least one, two, three, four, five, or more amino acid mutations (e.g., conservative or non-conservative substitutions), deletions or insertions can be introduced into a known MRD sequence and the resulting MRD can be screened for binding to the desired target and biological activity, such as the ability to antagonize target biological activity or to agonize target biological activity. In another embodiment, the sites selected for modification are affinity matured using phage display techniques known in the art. See, e.g., Lowman, Ann. Rev. Biophys. Biomol. Struct. 26:401-4 24 (1997).

Any technique for mutagenesis known in the art can be used to modify individual nucleotides in a DNA sequence, for purposes of making amino acid addition(s), substitution(s) or deletion(s) in the antibody sequence, or for creating/deleting restriction sites and sequences coding for desired amino acids (e.g., cysteine) to facilitate further manipulations. Such techniques include, but are not limited to, chemical mutagenesis, in vitro site-directed mutagenesis (Kunkel, Proc. Natl. Acad. Sci. USA 82:488 (1985); Hutchinson et al., J. Biol. Chem. 253:6551 (1978)), oligonucleotide-directed mutagenesis (Smith, Ann. Rev. Genet. 19:423-463 (1985); Hill et al., Methods Enzymol. 155:558-568 (1987)), PCR-based overlap extension (Ho et al., Gene 77:51-59 (1989)), PCR-based megaprimer mutagenesis (Sarkar et al., Biotechniques 8:404-407 (1990)), etc. Modifications can be confirmed by DNA sequencing.

Additional fusion proteins can be generated through the techniques of gene-shuffling, motif-shuffling, exon-shuffling, and/or codon-shuffling (collectively referred to as "DNA shuffling"). DNA shuffling can be employed to alter the activities of SYNAGIS® or fragments thereof (e.g., an antibody or a fragment thereof with higher affinities and lower dissociation rates). See, generally, U.S. Pat. Nos. 5,605,793, 5,811,238, 5,830,721, 5,834,252, and 5,837,458, and Patten et al., Curr. Opinion Biotechnol. 8:724-33 (1997); Harayama et al., Trends Biotechnol. 16(2):76-82 (1998); Hansson et al., J. Mol. Biol. 287:265-76 (1999); Lorenzo et al., Biotechniques 24(2):308-313 (1998); U.S. Appl. Publ. Nos. 20030118592 and 200330133939; and Int. Appl. Publ. No. WO02/056910; each of which is herein incorporated by reference in its entirety.

Additionally, MRDs can be identified based on their effects in assays that measure particular pathways or activities. For example, assays that measure signaling pathways (e.g., phosphorylation studies or multimerization), ion channel fluxes, intracellular cAMP levels, cellular activities such as migration, adherence, proliferation, or apoptosis, and viral entry, replication, budding, or integration can be used to identify, characterize, and improve MRDs.

Variants and derivatives of the MRDs that retain the ability to bind the target antigen are included within the scope of the present invention. Included within variants are insertional, deletional, and substitutional variants, as well as variants that include MRDs presented herein with additional amino acids at the N- and/or C-terminus, including from about 0 to 50, 0 to 40, 0 to 30, 0 to 20 amino acids and the like. It is understood that a particular MRD of the present invention may be modified to contain one, two, or all three types of variants. Insertional and substitutional variants may contain natural amino acids, unconventional amino acids, or both. In some embodiments, the MRD contains a sequence with no more than 1, 2, 3, 4, 5, 6, 7, 8, 9, 10, 15, or 20 amino acid differences when compared to an MRD sequence described herein. In some embodiments, the amino acid differences are substitutions. These substitutions can be conservative or non-conservative in nature and can include unconventional or non-natural amino acids. In other embodiments the MRD contains a sequence that competitively inhibits the ability of an MRD-containing sequence described herein to bind with a target molecule. The ability of an MRD to competitively inhibit another MRD-containing sequence can be determined using techniques known in the art, including ELISA and BIAcore analysis.

The ability of an MRD to bind its target can be assessed using any technique that assesses molecular interaction. For example, MRD-target interaction can be assayed as described in the Examples below or alternatively, using in vitro or in vivo binding assays such as western blots, radioimmunoassays, ELISA (enzyme linked immunosorbent assay), "sandwich" immunoassays, immunoprecipitation assays, fluorescent immunoassays, protein A immunoassays, and immunohistochemistry (IHC). Assays evaluating the ability of an MRD to functionally affect its target (e.g., assays to measure signaling, proliferation, migration etc.) can also be used to indirectly assess MRD-target interaction.

An improved MRD that has a particular half-life in vivo can also be prepared based on a known MRD sequence. For example, at least one, two, three, four, five, or more amino acid mutations (e.g., conservative or non-conservative substitutions), deletions or insertions can be introduced into a known MRD sequence and the resulting MRD can be screened for increased half-life. Thus, variants and derivatives of the MRDs that retain the ability to bind the target and have an increased half-life can be included in multivalent and multispecific compositions (e.g., MRD-containing antibodies). Thus, in some embodiments, an MRD in an MRD-containing antibody has a half-life of at least about 5, at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 110, at least about 120, at least about 130, at least about 140, or at least about 150 hours. In some embodiments, an MRD in an MRD-containing antibody has a half-life of at least about 5, at least about 10, at least about 15, at least about 20, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 110, at least about 120, at least about 130, at least about 140, or at least about 150 hours.

Once the sequence of the MRD has been elucidated, the peptides may be prepared by any of the methods known in the art. For example, the MRD peptides can be chemically synthesized and operably attached to the antibody or can be synthesized using recombinant technology. For example, MRDs can be synthesized in solution or on a solid support using known techniques. Various automatic synthesizers are commercially available and can be used in accordance with known protocols. See, for example, Tam et al., J. Am. Chem. Soc. 105:6442 (1983); Merrifield, Science 232:341-347 (1986); Barany and Merrifield, The Peptides, Gross and Meienhofer, eds, Academic Press, New York, 1-284; Barany et al., Int. J. Pep. Protein Res., 30:705-739 (1987); and U.S. Pat. No. 5,424,398, each of which is incorporated herein by reference in its entirety.

MRDs can be synthesized with covalently attached molecules that are not amino acids but aid in the purification, identification, and/or tracking of an MRD in vitro or in vivo. (e.g., biotin for reacting with avidin or avidin-labeled molecules).

The following MRD targets are described in more detail by way of example only.

In some embodiments described herein, the MRD targets an integrin. The role of integrins such as αvβ3 and αvβ5 as tumor-associated markers has been well documented. A recent study of 25 permanent human cell lines established from advanced ovarian cancer demonstrated that all lines were positive for αvβ5 expression and many were positive for αvβ3 expression. Studies have also shown that αvβ3 and αvβ5 is highly expressed on malignant human cervical tumor tissues. Integrins have also demonstrated therapeutic effects in animal models of Kaposi's sarcoma, melanoma, and breast cancer.

A number of integrin αvβ3 and αvβ5 antagonists are in clinical development. These include cyclic RGD peptides and synthetic small molecule RGD mimetics. Two antibody-based integrin antagonists are currently in clinical trials for the treatment of cancer. The first is VITAXIN® (MEDI-522, Abegrein), the humanized form of the murine anti-human αvβ3 antibody LM609. A dose-escalating phase I study in cancer patients demonstrated that VITAXIN® is safe for use in humans. Another antibody in clinical trials is CNT095, a fully human Ab that recognizes αv integrins. A Phase I study of CNT095 in patients with a variety of solid tumors has shown that it is well tolerated. Cliengitide (EMD 121974), a peptide antagonist of αvβ3 and αvβ5, has also proven safe in phase I trials. Furthermore, there have been numerous drug targeting and imaging studies based on the use of ligands for these receptors. These preclinical and clinical observations demonstrate the importance of targeting αvβ3 and αvβ5 and studies involving the use of antibodies in this strategy have consistently reported that targeting through these integrins is safe.

Clinical trials are also ongoing for antagonists targeting α5vβ1 for treating metastatic melanoma, renal cell carcinoma, and non-small cell lung cancer (M200 (volociximab) and malignant glioma (ATN-161).

Integrin-binding MRDs containing one or more RGD tripeptide sequence motifs represent an example of MRDs of the invention. Ligands having the RGD motif as a minimum recognition domain and from which MRDs of the invention can be derived are well known, a partial list of which includes, with the corresponding integrin target in parenthesis, fibronectin (α3β1, α5β1, αvβ1, α11β3, αvβ3, and α3β1) fibrinogen (αMβ2 and α11bβ1) von Willebrand factor (α11bβ3 and αvβ3), and vitronectin (α11bβ3, αvβ3 and αvβ5).

In one embodiment, the RGD containing targeting MRD is a member selected from the group consisting of: YCRGDCT (SEQ ID NO:3); PCRGDCL (SEQ ID NO:4); TCRGDCY (SEQ ID NO:5); and LCRGDCF (SEQ ID NO:6).

A MRD that mimics a non-RGD-dependent binding site on an integrin receptor and having the target binding specificity of a high affinity ligand that recognizes the selected integrin is also contemplated in the present invention. MRDs that bind to an integrin receptor and disrupt binding and/or signaling activity of the integrin are also contemplated.

In some embodiments, the MRD targets an angiogenic molecule. Angiogenesis is essential to many physiological and pathological processes. Ang2 has been shown to act as a proangiogenic molecule. Administration of Ang2-selective inhibitors is sufficient to suppress both tumor angiogenesis and corneal angiogenesis. Therefore, Ang2 inhibition alone or in combination with inhibition of other angiogenic factors, such as VEGF, can represent an effective antiangiogenic strategy for treating patients with solid tumors.

It is contemplated that MRDs useful in the present invention include those that bind to angiogenic receptors, angiogenic factors, and/or Ang2. In a specific embodiment, an MRD of the invention binds Ang2. In further embodiments, the TIE2 binding component comprises a fragment of ANG2 that binds TIE2. In particular embodiments, compositions of the invention bind TIE2 and comprise amino acids 283-449 of the human ANG2 disclosed in NCBI Ref. Seq. No. NP_001138.1.

In one embodiment, the invention encompasses an MRD and/or MRD-containing antibody that binds Ang2 and contains an amino acid sequence selected from the group consisting of: SEQ ID NO:136-619 and 620, as set forth in Table 10. In another embodiment, the invention encompasses an MRD and/or MRD-containing antibody that competes for Ang2 binding with a polypeptide having an amino acid sequence selected from the group consisting of: SEQ ID NO: 136-619 and 620. In a further embodiment, the invention encompasses an MRD and/or MRD-containing antibody that binds to the same epitope of Ang2 as a polypeptide having an amino acid sequence selected from the group consisting of: SEQ ID NO:136-619 and 620.

In a particular embodiment, the invention encompasses an MRD and/or MRD-containing antibody that binds Ang2 and contains an amino acid sequence selected from the group consisting of: DCFWYPNPEWCY (ANG100; SEQ ID NO:621); KCPLLPDWASCH (ANG99; SEQ ID NO:622); TCQDYPFWRYCH (ANG53; SEQ ID NO:623); DCYFYPNPPHCY (ANG57; SEQ ID NO:624); PHEECYFYPNPPHCYTMS (ANG318; SEQ ID NO:625); DCAVYPNPPWCYKMEFGK (ANG202; SEQ ID NO: 626); RPILCPLLPDW ISCHEWL (ANG205; SEQ ID NO:627); and LWDDCYFFPNPPHCYNSP (ANG200; SEQ ID NO:628).

In an additional embodiment, the invention encompasses an MRD and/or MRD-containing antibody that competes for Ang2 binding with a polypeptide having an amino acid sequence selected from the group consisting of: SEQ ID NO: 621-627 and 628. In a further embodiment, the invention encompasses an MRD and/or MRD-containing antibody that binds to the same epitope of Ang2 as a polypeptide having an amino acid sequence selected from the group consisting of: SEQ ID NO:621-627 and 628.

In one embodiment, an MRD and/or MRD-containing antibody binds Ang2 and contains a sequence selected from the group consisting of: GAQTNFMPMDDLEQRLYEQFI LQQGLE (SEQ ID NO:9) (ANGa); LWDDCYFFP NPPH-CYNSP (SEQ ID NO:11) (ANGb); LWDDCYSYPNPPH-CYNSP (SEQ ID NO:12) (ANGc); LWDDCYSFPNPPH-CYNSP (SEQ ID NO:15) (ANGd); DCAVYPNPPWCYKME FGK (SEQ ID NO:16) (ANGe); PHEECYFY PNPPHCYTMS (SEQ ID NO:17) (ANGf); and PHEECYSYPNPPHCYTMS (SEQ ID NO:18) (ANGg).

In another embodiment, an MRD-containing antibody comprises an ANG-2 binding peptide disclosed in U.S. Pat. Nos. 7,309,483, 7,205,275, 7,138,370 7,063,965, 7,063,840, 7,045,302, 7,008,781, 6,825,008, 6,645,484, 6,627,415, 6,455,035, 6,441,137, 6,433,143, 6,265,564, 6,166,185, 5,879,672, 5,814,464, 5,681,714, 5,650,490, 5,643,755 and 5,521,073; and U.S. Appl. Publ. Nos. 2007/0225221, 2007/0093419, 2007/0093418, 2007/0072801, 2007/0025993, 2006/0122370, 2005/0186665, 2005/0175617, 2005/0106099, 2005/0100906, 2003/0236193, 2003/0229023, 2003/0166858, 2003/0166857, 2003/0162712, 2003/0109677, 2003/0092891, 2003/0040463, 2002/0173627 and 2002/0039992, and Intl. Appl. Publ. Nos. WO2006/005361, WO/2006/002854, WO2004/092215, WO/2004/076650, WO2003/057134, WO/2000/075323, WO2000/065085, WO/1998/018914 or WO1995/021866, the disclosures of each of which is herein incorporated by reference in its entirety.

In one embodiment, an MRD-containing antibody contains an MRD that preferentially binds ANG2 over ANG1 and ANG4. In a further embodiment, the MRD-containing antibody contains an MRD having a sequence selected from the group consisting of: ANG100 (SEQ ID NO:621), ANG156 (SEQ ID NO:255), ANG318 (SEQ ID NO:625) and ANG599 (SEQ ID NO:367). In an additional embodiment, an MRD-containing antibody contains an MRD that preferentially binds ANG1 and ANG2 over ANG4. In a further embodiment, the MRD-containing antibody contains an MRD having a sequence selected from the group consisting of: ANG126 (SEQ ID NO:232), ANG129 (SEQ ID NO:234), ANG179 (SEQ ID NO:270), ANG200 (SEQ ID NO:628), ANG303 (SEQ ID NO:331) and ANG335 (SEQ ID NO:332). In another embodiment, an MRD-containing antibody contains an MRD that binds ANG1, ANG2 and ANG4. In a further embodiment, the MRD-containing antibody contains an MRD having the sequence of ANG335 (SEQ ID NO:332). MRD-containing antibodies that compete for ANG1, ANG2 and/or ANG4 binding with one or more of the above MRDs and/or MRD-containing antibodies are also encompassed by the invention.

In some embodiments, the MRD targets vascular endothelial growth factor (VEGF). In one embodiment, the invention encompasses an MRD and/or MRD-containing antibody that binds VEGF and contains an amino acid sequence selected from the group consisting of: SEQ ID NOs:629-691 and 692, as set forth in Table 11. In another embodiment, the invention encompasses an MRD and/or MRD-containing antibody that competes for VEGF binding with a polypeptide having an amino acid sequence selected from the group consisting of: SEQ ID NOs:629-691 and 692. In a further embodiment, the invention encompasses an MRD and/or MRD-containing antibody that binds to the same epitope of VEGF as a polypeptide having an amino acid sequence selected from the group consisting of: SEQ ID NOs:629-691 and 692.

In a particular embodiment, the invention encompasses an MRD and/or MRD-containing antibody that binds VEGF and contains an amino acid sequence selected from the group consisting of: ACVKQVPWWLCI (VGF5; SEQ ID NO:693); TCWKPTPWWLCD (VGF26; SEQ ID NO:694); WCNGFPPNYPCY (VGF57; SEQ ID NO:695); GCVKEAPWWLCV (VGF61; SEQ ID NO:696); and WCNGFPANYPCY (VGF50; SEQ ID NO:697). In an additional embodiment, the invention encompasses an MRD and/or MRD-containing antibody that competes for VEGF binding with a polypeptide having an amino acid sequence selected from the group consisting of: SEQ ID NOs:693-696 and 697. In a further embodiment, the invention encompasses an MRD and/or MRD-containing antibody that binds to the same epitope of VEGF as a polypeptide having an amino acid sequence selected from the group consisting of: SEQ ID NOs:693-696 and 697.

In one embodiment, the antibody-MRD fusion comprises an MRD with the sequence ATWLPPP (SEQ ID NO:71), which inhibits VEGF-mediated angiogenesis. Binetruy-Tournaire et al., EMBO J. 19:1525-1533 (2000). In additional embodiments, an anti-VEGF antibody containing an MRD that targets VEGF is contemplated in the present invention. Anti-VEGF antibodies can be found for example in Presta et al., Cancer Research 57:4593-4599 (1997); and Fuh et al., J. Biol. Chem. 281:10 6625 (2006), each of which is herein incorporated by reference in its entirety.

Insulin-like growth factor-I receptor (IGF1R)-specific MRDs can also be used in the present invention. In one embodiment, the invention encompasses an MRD and/or MRD-containing antibody that binds IGF1R and contains an amino acid sequence selected from the group consisting of: SEQ ID NOs:698-1149 and 1150, as set forth in Table 12. In another embodiment, the invention encompasses an MRD and/or MRD-containing antibody that competes for IGF1R binding with a polypeptide having an amino acid sequence selected from the group consisting of: NO:698-1149 and 1150. In a further embodiment, the invention encompasses an MRD and/or MRD-containing antibody that binds to the same epitope of IGF1R as a polypeptide having an amino acid sequence selected from the group consisting of: NO:698-1149 and 1150.

In another embodiment, the invention encompasses an MRD and/or MRD-containing antibody that competes for IGF1R binding with a polypeptide having an amino acid sequence selected from the group consisting of: LCKEF-PELCF (IGF252; SEQ ID NO:1151); QPWEGYSWLY (IGF71; SEQ ID NO:1152); RITPSDLCKEFPELCF (IGF550; SEQ ID NO:1153); GFHHAYYKY RGQAGQG-SATGGSSRITPSDLCKEFP ELCF (IGF2044; SEQ ID NO:1154); LCHGYPWYGPCQGQAGQGSATGGSGS-TAS SRITPSDLCKEFPELCF (IGF2037: SEQ ID NO:1155); GSWCDHYPQPVMCLGQAG QGSATGGSS-RITPSDLCKEFPELCF (IGF2039 SEQ ID NO:1156); and TFENAL YCLAYGICDKITLI (IGF2045; SEQ ID NO:1157). In an additional embodiment, the invention encompasses an MRD and/or MRD-containing antibody that competes for IGF1R binding with a polypeptide having an amino acid sequence selected from the group consisting of: SEQ ID NO:1151-1156 and 1157. In a further embodiment, the invention encompasses an MRD and/or MRD-containing antibody that binds to the same epitope of IGF1R as a polypeptide having an amino acid sequence selected from the group consisting of: SEQ ID NO: SEQ ID NO:1151-1156 and 1157.

Vascular homing-specific MRDs are also contemplated for use in the present invention. A number of studies have characterized the efficacy of linking the vascular homing peptide to other proteins like IL12 or drugs to direct their delivery in live animals.

Numerous other target binding sites are contemplated as being the target of the antibody-MRD fusions of the present invention, including for example, FGFR1, FGFR2, EGFR, ErbB2, ErbB3, ErbB4, CD20, insulin-like growth factor-1 receptor, and hepatocyte growth factor receptor. MRDs can be directed towards these target binding sites or the corresponding ligands.

In one embodiment, the MRD binds to IL6. In some embodiments, the invention encompasses an MRD and/or MRD-containing antibody that binds IL6 and contains an amino acid sequence selected from the group consisting of: SEQ ID NO:1158-1731 and 1732, as set forth in Table 13. In another embodiment, the invention encompasses an MRD and/or MRD-containing antibody that competes for IL6 binding with a polypeptide having an amino acid sequence selected from the group consisting of: SEQ ID NO: 1158-1731 and 1732. In a further embodiment, the invention encompasses an MRD and/or MRD-containing antibody that binds to the same epitope of IL6 as a polypeptide having an amino acid sequence selected from the group consisting of: SEQ ID NO: 1158-1731 and 1732.

In a particular embodiment, the invention encompasses an MRD and/or MRD-containing antibody that binds IL6 and contains an amino acid sequence selected from the group consisting of: YCPWDPIMMQCA (ILB394; SEQ ID NO:1733); LSNSCAW DPLLMNCIDTH (ILB227; SEQ ID NO:1734); FNEDCMWDPLLMDCAYSP (ILB915; SEQ ID NO:1735); INNLSPVCYWDPLLMDCI (ILB235; SEQ ID NO:1736); VQY WEFETWEGQAGQGSFNEDCMWDPLLMDCAYSP (ILB914; SEQ ID NO:1737); HQADDPFGQWGQAGQGSFNEDCMWDPLLMDCAYSP (ILB910; SEQ ID NO:1738); PLWEQTKWQYGQAGQGSFNEDCMWDPLLMDCAYSP (ILB916; SEQ ID NO:1739); FNEDC MWDPLLMDCAYSPGQGSATGGSAAGGGSMCLTYEEICS (ILB790; SEQ ID NO:1740); ISMPCH SWEHCLSLL (ILB754; SEQ ID NO:1741); GWGRVCDADYCCWVVC (ILB753; SEQ ID NO:1742); EYDWCMWEVK MFEEACWSLS (ILB909; SEQ ID NO:1743); VLSECFEAYRVVCQALT (ILB913; SEQ ID NO:1744); MGIRCQTWDHCLSIL (ILB911; SEQ ID NO:1745); and QRYPCTTWEDCLVVL (ILB912; SEQ ID NO:1746). In an additional embodiment, the invention encompasses an MRD and/or MRD-containing antibody that competes for IL6 binding with a polypeptide having an amino acid sequence selected from the group consisting of: SEQ ID NO: 1733-1745 and 1746 In a further embodiment, the invention encompasses an MRD and/or MRD-containing antibody that binds to the same epitope of IL6 as a polypeptide having an amino acid sequence selected from the group consisting of: SEQ ID NO:1733-1745 and 1746.

In one embodiment, the MRD binds to IL6R. In some embodiments, the invention encompasses an MRD and/or MRD-containing antibody that binds IL6R and contains an amino acid sequence selected from the group consisting of: SEQ ID NO:1747-1908 and 1909, as set forth in Table 14. In another embodiment, the invention encompasses an MRD and/or MRD-containing antibody that competes for IL6R binding with a polypeptide having an amino acid sequence selected from the group consisting of: SEQ ID NO:1747-1908 and 1909. In a further embodiment, the invention encompasses an MRD and/or MRD-containing antibody that binds to the same epitope of IL6R as a polypeptide having an amino acid sequence selected from the group consisting of: SEQ ID NO:1747-1908 and 1909.

In a particular embodiment, the invention encompasses an MRD and/or MRD-containing antibody that binds IL6R and contains an amino acid sequence selected from the group consisting of: DLLYCEWEMVVRECHGTI (ILC111; SEQ ID NO:1910); EFVLCELAM VFRECHGAV (ILC82; SEQ ID NO:1911); ELIFCDLEMVFNECHGAI (ILC85; SEQ ID NO:1912); DYILCDLEMVFRECHGVL (ILC289; SEQ ID NO:1913); EFILCELEMVIRECHGTT (ILC92; SEQ ID NO:1914); PCE EAFAAYLE (ILC110; SEQ ID NO:1915); PCEEAFAAYLEEAYN (ILC134; SEQ ID NO:1916); ACEEAFASYLEENVM (ILC100; SEQ ID NO:1917); DCNALFTGDLAW (ILC145; SEQ ID NO:1918); DEEWTCFP TLCSLWSE (ILC51; SEQ ID NO:1919); EEEWTCFPSLCTIWSQ (ILC163; SEQ ID NO:1920); EEEWTCFPYLCSDWLQ (ILC168; SEQ ID NO:1921); EEEWTCFPYLCSEWVH (ILC235; SEQ ID NO:1922); QEEWTCFPYLCSYWAQ (ILC217; SEQ ID NO:1923); GQDDCWPYYCDELEY (ILC54 SEQ ID NO:1924); SCWTCIPEMVNCEAAH (ILC293; SEQ ID NO:1925); YWAKCDYHEGWHHCELHP (ILC296; SEQ ID NO:1926); VFWDCWYYGT WIECENTG (ILC295; SEQ ID NO:1927); GDTPCQEWPYWCLPPY (ILC290; SEQ ID NO:1928); HLISCEFHEKYVECVEVA (ILC291; SEQ ID NO:1929); STDYC EVLEIQWVCYRPP (ILC294; SEQ ID NO:1930); and QIVECWTEMDWHHCVLFF (ILC292 SEQ ID NO:1931). In an additional embodiment, the invention encompasses an MRD and/or MRD-containing antibody that competes for IL6R binding with a polypeptide having an amino acid sequence selected from the group consisting of: SEQ ID NO:1910-1930 and 1931. In a further embodiment, the invention encompasses an MRD and/or MRD-containing antibody that binds to the same epitope of IL6R as a polypeptide having an amino acid sequence selected from the group consisting of: SEQ ID NO:1910-1930 and 1931.

In one embodiment, the MRD binds to IL17a. In some embodiments, the invention encompasses an MRD and/or MRD-containing antibody that binds IL17a and contains an amino acid sequence selected from the group consisting of: SEQ ID NO:1932-1989 and 1990, as set forth in Table 15. In another embodiment, the invention encompasses an MRD and/or MRD-containing antibody that competes for IL17a binding with a polypeptide having an amino acid sequence selected from the group consisting of: SEQ ID NO:1932-1989 and 1990. In a further embodiment, the invention encompasses an MRD and/or MRD-containing antibody that binds to the same epitope of IL17a as a polypeptide having an amino acid sequence selected from the group consisting of: SEQ ID NO:1932-1989 and 1990.

In a particular embodiment, the invention encompasses an MRD and/or MRD-containing antibody that binds IL17a and contains the amino acid sequence LSLWCWLINDVNCSEPV (ILA72; SEQ ID NO:1991) or NPLWCWMFPADDPC VHPG (ILA20; SEQ ID NO:1992). In an additional embodiment, the invention encompasses an MRD and/or MRD-containing antibody that competes for IL17a binding with a polypeptide having the amino acid sequence of SEQ ID NO:1991 or SEQ ID NO:1992. In a further embodiment, the invention encompasses an MRD and/or MRD-containing antibody that binds to the same epitope of IL17a as a polypeptide having the amino acid sequence of SEQ ID NO:1991 or SEQ ID NO:1992.

In one embodiment, the MRD binds to TNFSF15 (TL1A). In some embodiments, the invention encompasses an MRD and/or MRD-containing antibody that binds TL1A and contains an amino acid sequence selected from the group consisting of: SEQ ID NO:1993-2234 and 2235, as set forth in Table 16. In another embodiment, the invention encompasses an MRD and/or MRD-containing antibody that competes for TL1A binding with a polypeptide having an amino acid sequence selected from the group consisting of: SEQ ID NO:1993-2234 and 2235. In a further embodiment, the invention encompasses an MRD and/or MRD-containing antibody that binds to the same epitope of TL1A as a polypeptide having an amino acid sequence selected from the group consisting of: SEQ ID NO:1993-2234 and 2235.

In a particular embodiment, the invention encompasses an MRD and/or MRD-containing antibody that binds TL1A and contains an amino acid sequence selected from the group consisting of: QDRVCWDFHQKLQFCELSM (TLA525; SEQ ID NO:2236); YSSVCWDDTRE ALFYCETTV (TLA27; SEQ ID NO:2237); EYALCWVEAQEK LEWCKGLN (TLA522; SEQ ID NO:2238); DYEVCWDVHVDRLVYCDAPM (TLA523; SEQ ID NO:2239); STEVCWDFIEQKLIWCSTFR (TLA35; SEQ ID NO:2240); QSDVCW NQSHQLLQFCWESN (TLA54; SEQ ID NO:2241); and DYAVCWDPDYG NLVWCNVLS (TLA524; SEQ ID NO:2242). In an additional embodiment, the invention encompasses an MRD and/or MRD-containing antibody that competes for TL1A binding with a polypeptide having an amino acid sequence selected from the group consisting of: 2236-2241 and 2242. In a further embodiment, the invention encompasses an MRD and/or MRD-containing antibody that binds to the same epitope of TL1A as a polypeptide having an amino acid sequence selected from the group consisting of: SEQ ID NO:2236-2241 and 2242.

In one embodiment, the MRD binds to TNFSF13B (BLyS). In a particular embodiment, the invention encompasses an MRD and/or MRD-containing antibody that binds BLyS and contains an amino acid sequence selected from the group consisting of: GDMGCWDWLTRTQVKCSLLV (BLY50; SEQ ID NO:2243); PRGTCWADPLT GQCVQVM (BLY47; SEQ ID NO:2244); PAGMCFDNLTLQMVQCTSLK (BLY35 SEQ ID NO:2245); GPWACYETPTRQMCVPVF (BLY69 SEQ ID NO:2246); ERKA CYFDPLVK QCLFVR (BLY60; SEQ ID NO:2247); TMPTCFMDPLTHQCWPSV (BLY34; SEQ ID NO:2248); HPGRCYDQLTYEWVTCWHLW (BLY31; SEQ ID NO:2249); RADLCYHEHH NNECFFGM (BLY73; SEQ ID NO:2250); and TGSSC WDILTKQMVPC LTAW (BLY27; SEQ ID NO:2251). In an additional embodiment, the invention encompasses an MRD and/or MRD-containing antibody that competes for BLyS binding with a polypeptide having an amino acid sequence selected from the group consisting of: SEQ ID NO: 2243-2250 and 2251. In a further embodiment, the invention encompasses an MRD and/or MRD-containing antibody that binds to the same epitope of BLyS as a polypeptide having an amino acid sequence selected from the group consisting of: SEQ ID NO:2243-2250 and 2251.

In one embodiment, the MRD binds to HER2/3.

In another embodiment, the MRD binds EGFR. In some embodiments, the invention encompasses an MRD and/or MRD-containing antibody that binds EGFR and contains an amino acid sequence selected from the group consisting of: SEQ ID NO:2252-3090 and 3091, as set forth in Table 17. In another embodiment, the invention encompasses an MRD and/or MRD-containing antibody that competes for EGFR binding with a polypeptide having an amino acid sequence selected from the group consisting of: SEQ ID NO:2252-3090 and 3091. In a further embodiment, the invention encompasses an MRD and/or MRD-containing antibody that binds to the same epitope of EGFR as a polypeptide having an amino acid sequence selected from the group consisting of: SEQ ID NO:2252-3090 and 3091.

In a particular embodiment, the invention encompasses an MRD and/or MRD-containing antibody that binds EGFR and contains an amino acid sequence selected from the group consisting of: LTAPCYWTTWGKECLMLR (EGA79; SEQ ID NO:3092); LNDNCYWTTWGRECYLLR (EGA191; SEQ ID NO:3093); FSDPCYWTTWGR ECFLLP (EGA214; SEQ ID NO:3094); LPEGCYWTTWGKECLLLP (EGA234; SEQ ID NO:3095); LPQGCVWTNWGKECYLPL (EGA626; SEQ ID NO:3096); LPEGCW WSQWGKECLLLP (EGA623; SEQ ID NO:3097); LPQECYWAHWGKECYLPP (EGA625; SEQ ID NO:3098); LPEGCWWAPWGKECLLHP (EGA673 SEQ ID NO:3099); LPEDCWWSTWGRECLLPP (EGA990; SEQ ID NO:3100); ADSWCHTL YWQLHHCASWE (EGA349; SEQ ID NO:3101); EESLCHTLYRQLHNCRSLE (EGA406; SEQ ID NO:3102); ADSLCLTEYLELLQCERWE (EGA466; SEQ ID NO:3103); ADSLCQTRHQQLLDCERQE (EGA467; SEQ ID NO:3104); PESWCHTLY WNLQHCLSQE (EGA433; SEQ ID NO:3105); YAEHCWQFPTDWICTLMT (EGA518; SEQ ID NO:3106); YAEHCLMFPGDWICTLLP (EGA771; SEQ ID NO:3107); YASHCSQFPGDWICSLMT (EGA772; SEQ ID NO:3108); YAEHCRQ FPSDWICTLLP (EGA797; SEQ ID NO:3109); YADHCSQFPNDWICTLLS (EGA926; SEQ ID NO:3110); YAEHCSLFPTDWICTLMS (EGA958; SEQ ID NO:3111); and YAEHCSQFPSDWICSLLS (EGA917; SEQ ID NO:3112). In an additional embodiment, the invention encompasses an MRD and/or MRD-containing antibody that competes for EGFR binding with a polypeptide having an amino acid sequence selected from the group consisting of: SEQ ID NO:3092-3111 and 3112. In a further embodiment, the invention encompasses an MRD and/or MRD-containing antibody that binds to the same epitope of EGFR as a polypeptide having an amino acid sequence selected from the group consisting of: SEQ ID NO:3092-3111 and 3112.

In another embodiment, the MRD binds ErbB2. In some embodiments, the invention encompasses an MRD and/or MRD-containing antibody that binds ErbB2 and contains an amino acid sequence selected from the group consisting of: SEQ ID NO: 3113-3494 and 3495 as set forth in Table 18. In another embodiment, the invention encompasses an MRD and/or MRD-containing antibody that competes for ErbB2 binding with a polypeptide having an amino acid sequence selected from the group consisting of: SEQ ID NO: 3113-3494 and 3495. In a further embodiment, the invention encompasses an MRD and/or MRD-containing antibody that binds to the same epitope of ErbB2 as a polypeptide having an amino acid sequence selected from the group consisting of: SEQ ID NO: 3113-3494 and 3495.

In a particular embodiment, the invention encompasses an MRD and/or MRD-containing antibody that binds ErbB2 and contains an amino acid sequence selected from the group consisting of: SAISCYVYQQHRHCDWDH (EGB417; SEQ ID NO:3496); WSGYCEMKDHWAHCGHSE (EGB390; SEQ ID NO:3497); and WSGYCETPS-GWK ACRGNI (EGB858; SEQ ID NO:3498). In an additional embodiment, the invention encompasses an MRD and/or MRD-containing antibody that competes for ErbB2 binding with a polypeptide having the amino acid sequence of SEQ ID NO:3496, SEQ ID NO:3497 or SEQ ID NO:3498. In a further embodiment, the invention encompasses an MRD and/or MRD-containing antibody that binds to the same epitope of ErbB2 as a polypeptide having the amino acid sequence of SEQ ID NO:3496, SEQ ID NO:3497 or SEQ ID NO:3498.

In another embodiment, the MRD binds ErbB3. In some embodiments, the invention encompasses an MRD and/or MRD-containing antibody that binds ErbB3 contains an amino acid sequence selected from the group consisting of: SEQ ID NO:3499-4086 and 4087, as set forth in Table 19. In another embodiment, the invention encompasses an MRD and/or MRD-containing antibody that competes for ErbB3 binding with a polypeptide having an amino acid sequence selected from the group consisting of: SEQ ID NO:3499-4086 and 4087. In a further embodiment, the invention encompasses an MRD and/or MRD-containing antibody that binds to the same epitope of ErbB3 as a polypeptide having an amino acid sequence selected from the group consisting of: SEQ ID NO:3499-4086 and 4087.

In a particular embodiment, the invention encompasses an MRD and/or MRD-containing antibody that binds ErbB3 and contains an amino acid sequence selected from the group consisting of: SSETYCPFLNPYWYDQCMSRT (EGC1077; SEQ ID NO:4088); SEPYCPFLNPTWKSQ-CIART (EGC180; SEQ ID NO:4089); SQVSCP FQNPIW-WSHCMELM (EGC42; SEQ ID NO:4090); GSKPYCPFT-NPIWYDECIKRS (EGC593; SEQ ID NO:4091); ATEPYCPFLNPIWKAECLARS (EGC503; SEQ ID NO:4092); KFLMCQVYPSEKWHVCVETL (EGC41 SEQ ID NO:4093); and SKPYC PFTNPI-WYDECIKRSGGGSGGGSQAAAGGSYMHEPHMQV-LEIMN (EGC1086; SEQ ID NO:4094). In an additional embodiment, the invention encompasses an MRD and/or MRD-containing antibody that competes for ErbB3 binding with a polypeptide having an amino acid sequence selected from the group consisting of: SEQ ID NO:4088-4093 and 4094. In a further embodiment, the invention encompasses an MRD and/or MRD-containing antibody that binds to the same epitope of ErbB3 as a polypeptide having an amino acid sequence selected from the group consisting of: SEQ ID NO:4088-4093 and 4094.

Insulin-like growth factor-I receptor (ErbB4)-specific MRDs can also be used in the present invention. In one embodiment, the invention encompasses an MRD and/or MRD-containing antibody that binds ErbB4 and contains an amino acid sequence selected from the group consisting of: SEQ ID NO:4095-4123 and 4124, as set forth in Table 20. In another embodiment, the invention encompasses an MRD and/or MRD-containing antibody that competes for ErbB4 binding with a polypeptide having an amino acid sequence selected from the group consisting of: SEQ ID NO:4095-4123 and 4124. In a further embodiment, the invention encompasses an MRD and/or MRD-containing antibody that binds to the same epitope of ErbB4 as a polypeptide having an amino acid sequence selected from the group consisting of: SEQ ID NO:4095-4123 and 4124.

In another embodiment, the MRD binds TNFRSF10B (DR5). In some embodiments, the invention encompasses an MRD and/or MRD-containing antibody that binds DR5 and contains an amino acid sequence selected from the group consisting of: SEQ ID NO:4125-4319 and 4320, as set forth in Table 21. In another embodiment, the invention encompasses an MRD and/or MRD-containing antibody that competes for DR5 binding with a polypeptide having an amino acid sequence selected from the group consisting of: SEQ ID NO:4125-4319 and 4320. In a further embodiment, the invention encompasses an MRD and/or MRD-containing antibody that binds to the same epitope of DR5 as a polypeptide having an amino acid sequence selected from the group consisting of: SEQ ID NO:4125-4319 and 4320.

In a particular embodiment, the invention encompasses an MRD and/or MRD-containing antibody that binds DR5 and contains the amino acid sequence of WDCLGKLGQR QCVKL (DR5218; SEQ ID NO:4321) or FPRPCAEEDVI-MTCRWRV (DR53; SEQ ID NO:4322). In an additional embodiment, the invention encompasses an MRD and/or MRD-containing antibody that competes for DR5 binding with a polypeptide having the amino acid sequence of SEQ ID NO:4321 or SEQ ID NO:4322. In a further embodiment, the invention encompasses an MRD and/or MRD-containing antibody that binds to the same epitope of DR5 as a polypeptide having the amino acid sequence of SEQ ID NO:4321 or SEQ ID NO:4322. As demonstrated herein, increasing the valency of DR5 MRDs in an MRD-containing antibody results in a corresponding increase in DR-5 mediated cell cytotoxicity (see, Example 46). Thus, in additional embodiments, the invention encompasses an MRD-containing antibody that contains at least 4, at least 6, at least 8 or at least 10 MRDs that bind DR5. Additionally, as demonstrated herein, increasing the multi-epitopic targeting for a target other than DR5 (e.g., ErbB2 and EGFR) in a DR5-binding MRD-containing antibody correlates with increased DR5 mediated cell cytotoxicity Thus, in additional embodiments, the invention encompasses an MRD-containing antibody that binds DR5 and at least two distinct epitopes of a target other than DR5. Moreover, as demonstrated herein, the antibody scaffold of a DR5-binding MRD containing antibody influences the level of DR5 mediated cell cytotoxicity of the MRD-containing antibody. In some embodiments, the antibody combining site of the DR5-binding MRD-containing antibody binds a molecule on the surface of a targeted cell expressing DR5. In a further embodiment, the antibody combining site of the MRD-containing antibody binds a molecule on the surface of a cell and MRDs of the MRD-containing antibody binds DR5 through one or more epitopes with a valency of 2, 3, 4, 5, 6, 7, 8, 9, 10, or more. In alternative embodiments, the antibody combining site of a DR5-binding MRD-containing antibody does not bind to a molecule on the surface of a targeted cell that expresses DR5 on its surface. In a further embodiment, the antibody combining site of the MRD-containing antibody does not bind a molecule on the surface of a targeted cell and MRDs of the MRD-containing antibody binds DR5 through one or more epitopes with a valency of 2, 3, 4, 5, 6, 7, 8, 9, 10, or more.

In additional embodiments, the invention encompasses an MRD and/or MRD-containing antibody that binds DR4 (TNFRSF10A/TRAIL R1). In further embodiments, the MRD-containing antibody contains at least 4, at least 6, at least 8 or at least 10 MRDs that bind DR4 (TNFRSF10A/(TRAIL R1). In additional embodiments, the invention encompasses an MRD-containing antibody that binds DR4 and at least two distinct epitopes of a target other than DR4. In some embodiments, the antibody combining site of the DR4-binding MRD-containing antibody binds a molecule on the surface of a targeted cell expressing DR4. In a further embodiment, the antibody of the MRD-containing antibody binds a molecule on the surface of a cell and MRDs of the MRD-containing antibody binds DR4 through one or more epitopes with a valency of 2, 3, 4, 5, 6, 7, 8, 9, 10, or more. In alternative embodiments, the antibody combining site of a DR4-binding MRD-containing antibody does not bind to a molecule on the surface of a targeted cell that expresses DR4 on its surface. In a further embodiment, the antibody combining site of the MRD-containing antibody does not bind a molecule on the surface of a targeted cell and MRDs of the MRD-containing antibody binds DR4 through one or more epitopes with a valency of 2, 3, 4, 5, 6, 7, 8, 9, 10, or more.

In further embodiments, the invention encompasses an MRD-containing antibody that binds a cell surface signaling molecule. In further embodiments, the MRD-containing antibody contains at least 4, at least 6, at least 8 or at least 10 MRDs that bind the cell surface signaling molecule. In particular embodiments, the cell surface signaling molecule is a member selected from: c-Met, EGFR, ErbB2, VEGFR1, VEGFR2, VEGFR3, FGFR1 (e.g., FGFR1-IIIC), FGFR2 (e.g., FGFR2-IIIa, FGFR2-IIIb, and FGFR2-IIIc), FGFR3, PDGFRA, PDGFRB, netrin, CD28, TNFRSF1A (TNFR1, p55, p60), TNFRSF1B (TNFR2), TNFRSF6 (Fas, CD95), TNFRSF21 or TNFRSF25, TNFRSF7 (CD27), TNFRSF8 (CD30), TNFRSF11A (RANK), TNFRSF21 (DR6), TNFRSF25 (DR3) and LRP6. In additional embodiments, the invention encompasses an MRD-containing antibody that binds the cell surface signaling molecule and at least two distinct epitopes of a target other than the cell surface signaling molecule. In some embodiments, the antibody combining site of the MRD-containing antibody binds a molecule on the surface of a targeted cell expressing the cell surface signaling molecule. In a further embodiment, the antibody of the MRD-containing antibody binds a molecule on the surface of a cell and MRDs of the MRD-containing antibody binds the cell surface signaling molecule through one or more epitopes with a valency of 2, 3, 4, 5, 6, 7, 8, 9, 10, or more. In alternative embodiments, the antibody combining site of a cell surface signaling molecule-binding MRD-containing antibody does not bind to a molecule on the surface of a targeted cell that expresses the cell surface signaling molecule. In a further embodiment, the antibody combining site of the MRD-containing antibody does not bind a molecule on the surface of a targeted cell and MRDs of the MRD-containing antibody binds the cell surface signaling molecule through one or more epitopes with a valency of 2, 3, 4, 5, 6, 7, 8, 9, 10, or more.

In another embodiment, the MRD binds CD19. In some embodiments, the invention encompasses an MRD and/or MRD-containing antibody that binds CD19 and contains an amino acid sequence selected from the group consisting of: STLTCQVWLEDWYECIEVD (CDA1; SEQ ID NO:4323); PNWVCWET PWTYECLEIE (CDA16; SEQ ID NO:4324); VLLH CFGEPQWMECVPYV (CDA26; SEQ ID NO:4325); FSPFCQYFQEFGECHYLS (CDA33; SEQ ID NO:4326); LLLRCM YEPYYWELQCVEVE (CDA48; SEQ ID NO:4327); and YIYTCSFIWDYQEIYCSPEL (CDA53; SEQ ID NO:4328). In an additional embodiment, the invention encompasses an MRD and/or MRD-containing antibody that competes for CD19 binding with a polypeptide having an amino acid sequence selected from the group consisting of: SEQ ID NO:4323-4327 and 4328. In a further embodiment, the invention encompasses an MRD and/or MRD-containing antibody that binds to the same epitope of CD19 as a polypeptide having an amino acid sequence selected from the group consisting of: SEQ ID NO:4323-4327 and 4328.

In some embodiments, the MRD binds to a human protein. In some embodiments, the MRD binds to both a human protein and its ortholog in mouse, rat, rabbit, or hamster.

III. Antibodies

The antibody in the multivalent and multispecific compositions (e.g., MRD-containing antibodies) described herein can be any suitable antigen-binding immunoglobulin. In certain embodiments, the MRD-containing antibody molecules described herein retain the structural and functional properties of traditional monoclonal antibodies. Thus, the antibodies retain their epitope binding properties, but advantageously also incorporate one or more additional target-binding specificities.

Antibodies that can be used in the multivalent and multispecific compositions (e.g., MRD-containing antibodies) include, but are not limited to, monoclonal, multispecific, human, humanized, primatized, and chimeric antibodies. Immunoglobulin or antibody molecules of the invention can be of any type (e.g., IgG, IgE, IgM, IgD, IgA, and IgY), class (e.g., IgG1, IgG2, IgG3, IgG4, IgA1 and IgA2) or subclass of immunoglobulin molecule. In specific embodiments, the antibodies are IgG1. In other specific embodiments, the antibodies are IgG3.

Antibodies that can be used as part of the multivalent and multispecific compositions (e.g., MRD-containing antibodies) can be naturally derived or the result of recombinant engineering (e.g., phage display, xenomouse, and synthetic). The antibodies can include modifications, for example, to enhance half-life or to increase or decrease antibody dependent cellular cytotoxicity (ADCC) and/or complement dependent cytotoxicity (CDC) activity. Antibodies can be from or derived from any animal origin including birds and mammals or generated synthetically. In some embodiments, the antibodies are human, murine, donkey, rabbit, goat, guinea pig, camel, llama, horse, or chicken antibodies. In specific embodiments, the antibodies are human.

In certain embodiments, the heavy chain portions of one polypeptide chain of a multimer are identical to those on a second polypeptide chain of the multimer. In alternative embodiments, the heavy chain portion-containing monomers of the invention are not identical. For example, each monomer may comprise a different target binding site, forming, for example, a bispecific antibody.

Bispecific, bivalent antibodies, and methods of making them, are described, for instance in U.S. Pat. Nos. 5,731,168, 5,807,706, 5,821,333, and U.S. Appl. Publ. Nos. 2003/020734 and 2002/0155537; each of which is herein incorporated by reference in its entirety. Bispecific tetravalent antibodies, and methods of making them are described, for instance, in Int. Appl. Publ. Nos. WO02/096948 and WO00/44788, the disclosures of both of which are herein incorporated by reference in its entirety. See generally, Int. Appl. Publ. Nos. WO93/17715, WO92/08802, WO91/00360, and WO92/05793; Tutt et al., J. Immunol. 147:60-69 (1991); U.S. Pat. Nos. 4,474,893; 4,714,681; 4,925,648; 5,573,920; and 5,601,819; and Kostelny et al., J. Immunol. 148:1547-1553 (1992).

The heavy chain portions of the antibody component of the MRD-antibody fusions for use in the methods disclosed herein may be derived from different immunoglobulin molecules. For example, a heavy chain portion of a polypeptide may comprise a CH1 domain derived from an IgG1 molecule and a hinge region derived from an IgG3 molecule. In another example, a heavy chain portion can comprise a hinge region derived, in part, from an IgG1 molecule and, in part, from an IgG3 molecule. In another example, a heavy chain portion can comprise a chimeric hinge region derived, in part, from an IgG1 molecule and, in part, from an IgG4 molecule.

In some embodiments, the antigen binding domains of the antibody component of the multivalent and multispecific compositions (e.g., MRD-containing antibodies) bind to their target with a dissociation constant or Kd of less than $5\times10^{-3}$ M, $10^{-3}$ M, $5\times10^{-4}$ M, $10^{-4}$ M, $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$, M, $10^{-10}$ M, $4\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, or $10^{-15}$ M. In one embodiment, the antibody component of the multivalent and multispecific compositions (e.g., MRD-containing antibodies) have a dissociation constant or Kd of less than $5\times10^{-5}$ M. In another embodiment, antigen binding of the antibody component of the multivalent and multispecific compositions (e.g., MRD-containing antibodies) has a dissociation constant or Kd of less than $5\times10^{-8}$ M. In another embodiment, antigen binding of the antibody component of the multivalent and multispecific compositions (e.g., MRD-containing antibodies) has a dissociation constant or Kd of less than less than $5\times10^{-9}$ M. In another embodiment, the antibody component of the multivalent and multispecific compositions (e.g., MRD-containing antibodies) have a dissociation constant or Kd of less than $5\times10^{-10}$ M. In another embodiment, the antibody component of the multivalent and multispecific compositions (e.g., MRD-containing antibodies) have a dissociation constant or Kd of less than $5\times10^{-11}$ M. In another embodiment, the antibody component of the multivalent and multispecific compositions (e.g., MRD-containing antibodies) have a dissociation constant or Kd of less than $5\times10^{-12}$ M.

In specific embodiments, the antibody component of the MRD-containing antibody binds its target with an off rate ($k_{off}$) of less than $5\times10^{-2}$ sec$^{-1}$, $10^{-2}$ sec$^{-1}$, $5\times10^{-3}$ sec$^{-1}$, or $10^{-3}$ sec$^{-1}$. More preferably, the antibody component of the MRD-containing antibody binds its target with an off rate ($k_{off}$) of less than $5\times10^{4}$ sec$^{-1}$, $10^{-4}$ sec$^{-1}$, $5\times10^{-5}$ sec$^{-1}$, or $10^{-5}$ sec$^{-1}$, $5\times10^{-6}$ sec$^{-1}$, $10^{-6}$ sec$^{-1}$, $5\times10^{-7}$ sec$^{-1}$, or $10^{-7}$ sec$^{-1}$.

In other specific embodiments, the antibody component of the MRD-containing antibody binds its target with an on rate ($k_{on}$) of greater than $10^{3}$ M$^{-1}$ sec$^{-1}$, $5\times10^{3}$ M$^{-1}$ sec$^{-1}$, $10^{4}$ M$^{-1}$ sec$^{-1}$, or $5\times10^{4}$ M$^{-1}$ sec$^{-1}$. More preferably, the antibody component of the MRD-containing antibody binds its target with an on rate ($k_{on}$) of greater than $10^{5}$ M$^{-1}$ sec$^{-1}$, $5\times10^{5}$ M$^{-1}$ sec$^{-1}$, $10^{6}$ M$^{-1}$ sec$^{-1}$, or $5\times10^{6}$ M$^{-1}$ sec$^{-1}$, or $10^{7}$ M$^{-1}$ sec$^{-1}$.

Affinity maturation strategies and chain shuffling strategies (e.g., gene-shuffling, motif-shuffling, exon-shuffling, and/or codon-shuffling (collectively referred to as "DNA shuffling") are known in the art and can be employed to generate high affinity and/or to alter the activities (e.g., ADCC and CDC) of multivalent and multispecific compositions (e.g., multivalent and multispecific compositions (e.g., MRD-containing antibodies)). See, e.g., U.S. Pat. Nos. 5,605,793, 5,811,238, 5,830,721, 5,834,252 and 5,837,458; and Patten et al., Curr. Opinion Biotechnol. 8:724-733 (1997), Harayama, Trends Biotechnol. 16(2):76-82 (1998), Hansson et al., J. Mol. Biol. 287:265-276 (1999) and Lorenzo and Blasco, Biotechniques 24(2):308-313 (1998); each of which is herein incorporated by reference in its entirety. Advantageously, affinity maturation strategies and chain shuffling strategies can routinely be applied to generate multivalent and multispecific compositions (e.g., MRD-containing antibodies) can also include variants and derivatives that improve antibody function and/or desirable pharmacodynamic properties.

Accordingly, certain embodiments of the invention include an antibody-MRD fusion, in which at least a fraction of one or more of the constant region domains has been altered so as to provide desired biochemical characteristics such as reduced or increased effector functions, the ability to non-covalently dimerize, increased ability to localize at the site of a tumor, reduced serum half-life, or increased serum half-life when compared with an unaltered antibody of approximately the same immunoreactivity. The alterations of the constant region domains can be amino acid substitutions, insertions, or deletions.

"Antibody-dependent cell-mediated cytotoxicity" or "ADCC" refers to a form of cytotoxicity in which secreted Ig bound onto Fc receptors (FcRs) expressed on certain cytotoxic cells (e.g., Natural Killer (NK) cells, neutrophils, and macrophages) enables these cytotoxic effector cells to localize to an antigen-bearing target cell and subsequently kill the target cell with cytotoxins. Specific high-affinity IgG antibodies directed to the surface of target cells "arm" the cytotoxic cells and are required for such killing. Lysis of the target cell is extracellular, requires contact or close proximity between the cytotoxic cells and target cells, and does not involve complement.

As used herein, the term "enhances ADCC" (e.g., referring to cells) is intended to include any measurable increase in cell lysis when contacted with a variant MRD-containing antibody as compared to the cell killing of the same cell in contact with a MRD-containing antibody that has not been so modified in a way that alters ADCC in the presence of effector cells (for example, at a ratio of target cells:effector cells of 1:50), e.g., an increase in cell lysis by at least about 10%, 20%, 30%, 40%, 50%, 60%, 70%, 80%, 90%, 100%, 150%, 200%, 250%, 300%, or 325%.

In certain embodiments, the antibody component of the antibody-MRD fusion has been modified to increase antibody dependent cellular cytotoxicity (ADCC) (see, e.g., Bruhns et al., Blood 113:3716-3725 (2009); Shields et al., J. Biol. Chem. 276:6591-6604 (2001); Lazar et al., Proc. Natl. Acad. Sci. USA 103:4005-4010 (2006); Stavenhagen et al., Cancer Res., 67:8882-8890 (2007); Horton et al., Cancer Res. 68:8049-8057 (2008); Zalevsky et al., Blood 113:3735-3743 (2009); Bruckheimer et al., Neoplasia 11:509-517 (2009); Allan et al., WO2006/020114; Strohl, Curr. Op. Biotechnol. 20:685-691 (2009); and Watkins et al., WO2004/074455, each of which is herein incorporated by reference in its entirety). Examples of Fc sequence engineering modifications contained in the antibody component of the antibody-MRD fusions that increases ADCC include one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; and IgG1-F243L, R292P, Y300L, V305I, P396L; wherein the numbering of the residues in the Fc region is that of the EU index as in Kabat.

In one embodiment, an Fc variant protein has enhanced ADCC activity relative to a comparable molecule. In a specific embodiment, an Fc variant protein has ADCC activity that is at least 2 fold, or at least 3 fold, or at least 5 fold or at least 10 fold or at least 50 fold or at least 100 fold greater than that of a comparable molecule. In another specific embodiment, an Fc variant protein has enhanced binding to the Fc receptor Fc gamma RIIIA and has enhanced ADCC activity relative to a comparable molecule. In other embodiments, the Fc variant protein has both enhanced ADCC activity and enhanced serum half-life relative to a comparable molecule.

The ability of any particular Fc variant protein to mediate lysis of the target cell by ADCC can be assayed using techniques known in the art. For example, to assess ADCC activity a multivalent and monovalent multispecific composition (e.g., an MRD-containing antibody) can be added to target cells in combination with immune effector cells, which can be activated by the antigen antibody complexes resulting in cytolysis of the target cell. Cytolysis is generally detected by the release of label (e.g., radioactive substrates, fluorescent dyes or natural intracellular proteins) from the lysed cells. Useful effector cells for such assays include peripheral blood mononuclear cells (PBMC) and Natural Killer (NK) cells. Specific examples of in vitro ADCC assays are described in Wisecarver et al., J Immunol Methods 79:277-282 (1985); Bruggemann et al., J. Exp. Med. 166:1351-1361 (1987); Wilkinson et al., J. Immunol. Methods 258:183-191 (2001); Patel et al., J. Immunol. Methods 184:29-38 (1995). Alternatively, or additionally, ADCC activity of the multivalent and monovalent multispecific composition (e.g., an MRD-containing antibody) can be assessed in vivo, e.g., in an animal model such as that disclosed in Clynes et al., PNAS USA 95:652-656 (1998), and U.S. Pat. No. 7,662,925.

In certain embodiments, the antibody component of the antibody-MRD fusion has been modified to decrease ADCC (see, e.g., Idusogie et al., J. Immunol. 166:2571-2575 (2001); Sazinsky et al., Proc. Natl. Acad. Sci. USA 105:20167-20172 (2008); Davis et al., J. Rheumatol. 34:2204-2210 (2007); Bolt et al., Eur. J. Immunol. 23:403-411 (1993); Alegre et al., Transplantation 57:1537-1543 (1994); Xu et al., Cell Immunol. 200:16-26 (2000); Cole et al., Transplantation 68:563-571 (1999); Hutchins et al., Proc. Natl. Acad. Sci. USA 92:11980-11984 (1995); Reddy et al., J. Immunol. 164:1925-1933 (2000); Int. Appl. Publ. No. WO1997/11971, and WO2007/106585; U.S. Appl. Publ. 2007/0148167A1; McEarchern et al., Blood 109:1185-1192 (2007); Strohl, Curr. Op. Biotechnol. 20:685-691 (2009); and Kumagai et al., J. Clin. Pharmacol. 47:1489-1497 (2007), each of which is herein incorporated by reference in its entirety). Examples of Fc sequence engineering modifications contained in the antibody component of the antibody-MRD fusions that decreases ADCC include one or more modifications corresponding to: IgG1-K326W, E333S; IgG2-E333S; IgG1-N297A; IgG1-L234A, L235A; IgG2-V234A, G237A; IgG4-L235A, G237A, E318A; IgG4-S228P, L236E; IgG2-EU sequence 118-260; IgG4-EU sequence 261-447; IgG2-H268Q, V309L, A330S, A331S; IgG1-C220S, C226S, C229S, P238S; IgG1-C226S, C229S, E233P, L234V, L235A; and IgG1-L234F, L235E, P331S.

In certain embodiments, the antibody component of the antibody-MRD fusion has been modified to increase antibody-dependent cell phagocytosis (ADCP); (see, e.g., Shields et al., J. Biol. Chem. 276:6591-6604 (2001); Lazar et al., Proc. Natl. Acad. Sci. USA 103:4005-4010 (2006); Stavenhagen et al., Cancer Res., 67:8882-8890 (2007); Richards et al., Mol. Cancer Ther. 7:2517-2527 (2008); Horton et al., Cancer Res. 68:8049-8057 (2008), Zalevsky et al., Blood 113:3735-3743 (2009); Bruckheimer et al., Neoplasia 11:509-517 (2009); Allan et al., WO2006/020114; Strohl, Curr. Op. Biotechnol. 20:685-691 (2009); and Watkins et al., WO2004/074455, each of which is herein incorporated by reference in its entirety.). Examples of Fc sequence engineering modifications contained in the antibody component of the antibody-MRD fusions that increases ADCP include one or more modifications corresponding to: IgG1-S298A, E333A, K334A; IgG1-S239D, I332E; IgG1-S239D, A330L, I332E; IgG1-P247I, A339D or Q; IgG1-D280H, K290S with or without S298D or V; IgG1-F243L, R292P, Y300L; IgG1-F243L, R292P, Y300L, P396L; IgG1-F243L, R292P, Y300L, V305I, P396L; IgG1-G236A, S239D, I332E.

In certain embodiments, the antibody component of the antibody-MRD fusion has been modified to decrease ADCP (see, e.g., Sazinsky et al., Proc. Natl. Acad. Sci. USA 105:20167-20172 (2008); Davis et al., J. Rheumatol. 34:2204-2210 (2007); Bolt et al., Eur. J. Immunol. 23:403-411 (1993); Alegre et al., Transplantation 57:1537-1543 (1994); Xu et al., Cell Immunol. 200:16-20 (2000); Cole et al., Transplantation 68:563-571 (1999); Hutchins et al., Proc. Natl. Acad. Sci. USA 92:11980-11984 (1995); Reddy et al., J. Immunol. 164:1925-1933 (2000); Intl. Appl. Publ. Nos. WO1997/11971 and WO2007/106585; U.S. Appl. Publ. 2007/0148167; McEarchern et al., Blood 109:1185-1192 (2007); Strohl, Curr. Op. Biotechnol. 20:685-691 (2009); and Kumagai et al., J. Clin. Pharmacol. 47:1489-1497 (2007), each of which is herein incorporated by reference in its entirety). Examples of Fc sequence engineering modifications contained in the antibody component of the antibody-MRD fusions that decreases ADCC include one or more modifications corresponding to: IgG1-N297A; IgG1-L234A, L235A; IgG2-V234A, G237A; IgG4-L235A, G237A, E318A; IgG4-S228P, L236E; IgG2 EU sequence 118-260; IgG4-EU sequence 261-447; IgG2-H268Q, V309L, A330S, A331S; IgG1-C220S, C226S, C229S, P238S; IgG1-C226S, C229S, E233P, L234V, L235A; and IgG1-L234F, L235E, P331S.

"Complement dependent cytotoxicity" and "CDC" refer to the lysing of a target cell in the presence of complement. The complement activation pathway is initiated by the binding of the first component of the complement system (C1q) to a molecule, an antibody for example, complexed with a cognate antigen. To assess complement activation, a CDC assay, e.g., as described in Gazzano-Santoro et al., J. Immunol. Methods 202:163 (1996), can be performed. In one embodiment, an Fc variant protein has enhanced CDC activity relative to a comparable molecule. In a specific embodiment, an Fc variant protein has CDC activity that is at least 2 fold, or at least 3 fold, or at least 5 fold, or at least 10 fold, or at least 50 fold, or at least 100 fold greater than that of a comparable molecule. In other embodiments, the Fc variant protein has both enhanced CDC activity and enhanced serum half-life relative to a comparable molecule.

In certain embodiments, the antibody component of the antibody-MRD fusions have been modified to increase complement-dependent cytotoxicity (CDC) (see, e.g., (see, e.g., Idusogic et al., J. Immunol. 166:2571-2575 (2001); Strohl, Curr. Op. Biotechnol. 20:685-691 (2009); and Natsume et al., Cancer Res. 68:3863-3872 (2008), each of which is herein incorporated by reference in its entirety). Examples of Fc sequence engineering modifications contained in the antibody component of the antibody-MRD fusions that increases CDC include one or more modifications corresponding to: IgG1-K326A, E333A; and IgG1-K326W, E333S, IgG2-E333S.

In one embodiment, the present invention provides formulations, wherein the Fc region comprises a non-naturally occurring amino acid residue at one or more positions selected from the group consisting of 234, 235, 236, 239, 240, 241, 243, 244, 245, 247, 252, 254, 256, 262, 263, 264, 265, 266, 267, 269, 296, 297, 298, 299, 313, 325, 326, 327, 328, 329, 330, 332, 333, and 334 as numbered by the EU index as set forth in Kabat. Optionally, the Fc region can comprise a non-naturally occurring amino acid residue at additional and/or alternative positions known to one skilled in the art (see, e.g., U.S. Pat. Nos. 5,624,821, 6,277,375, and 6,737,056; and Int. Appl. Publ. Nos. WO01/58957, WO02/06919, WO04/016750, WO04/029207, WO04/035752 and WO05/040217).

In specific embodiments MRD-containing antibodies of the invention contain an Fc variant comprising at least one non naturally occurring amino acid residue selected from the group consisting of 234D, 234E, 234N, 234Q, 234T, 234H, 234Y, 234I, 234V, 234F, 235A, 235D, 235R, 235W, 235P, 235S, 235N, 235Q, 235T, 235H, 235Y, 235I, 235V, 235F, 236E, 239D, 239E, 239N, 239Q, 239F, 239T, 239H, 239Y, 240I, 240A, 240T, 240M, 241W, 241L, 241Y, 241E, 241R, 243W, 243L 243Y, 243R, 243Q, 244H, 245A, 247V, 247G, 252Y, 254T, 256E, 262I, 262A, 262T, 262E, 263I, 263A, 263T, 263M, 264L, 264I, 264W, 264T, 264R, 264F, 264M, 264Y, 264E, 265G, 265N, 265Q, 265Y, 265F, 265V, 265I, 265L, 265H, 265T, 266I, 266A, 266T, 266M, 267Q, 267L, 269H, 269Y, 269F, 269R, 296E, 296Q, 296D, 296N, 296S, 296T, 296L, 296I, 296H, 269G, 297S, 297D, 297E, 298H, 298I, 298T, 298F, 299I, 299L, 299A, 299S, 299V, 200H, 299F, 299E, 313F, 325Q, 325L, 325I, 325D, 325E, 325A, 325T, 325V, 325H, 327G, 327W, 327N, 327L, 328S, 328M, 328D, 328E, 328N, 328Q, 328F, 328I, 328V, 328T, 328H, 328A, 329F, 329H, 329Q, 330K, 330G, 330T, 330C, 330L, 330Y, 330V, 330I, 330F, 330R, 330H, 332D, 332S, 332W, 332F, 332E, 332N, 332Q, 332T, 332H, 332Y, and 332A as numbered by the EU index as set forth in Kabat. Optionally, the Fc region can comprise additional and/or alternative non-naturally occurring amino acid residues known to one skilled in the art (see, e.g., U.S. Pat. Nos. 5,624,821, 6,277,375, and 6,737,056; and Int. Appl. Publ. Nos. WO01/58957, WO02/06919, WO04/016750, WO04/029207, WO04/035752 and WO05/040217).

In certain embodiments, the multivalent and monovalent multispecific composition is an antibody-MRD fusions wherein the antibody component has been modified to increase inhibitory binding to Fc gamma RIIb receptor (see, e.g., Chu et al., Mol. Immunol. 45:3926-3933 (2008)). An example of Fc sequence engineering modifications contained in the antibody component of the antibody-MRD fusions that increases binding to inhibitory Fc gamma RIIb receptor is IgG1-S267E, L328F.

In certain embodiments, the antibody component of the antibody-MRD fusions have been modified to decrease CDC (see, e.g., Int. Appl. Publ. Nos. WO1997/11971 and WO2007/106585; U.S. Appl. Publ. No 2007/0148167A1; McEarchern et al., Blood 109:1185-1192 (2007); Hayden-Ledbetter et al., Clin. Cancer 15:2739-2746 (2009); Lazar et al., Proc. Natl. Acad. Sci. USA 103:4005-4010 (2006); Bruckheimer et al., Neoplasia 11:509-517 (2009); Strohl, Curr. Op. Biotechnol. 20:685-691 (2009); and Sazinsky et al., Proc. Natl. Acad. Sci. USA 105:20167-20172 (2008); each of which is herein incorporated by reference in its entirety). Examples of Fc sequence engineering modifications contained in the antibody component of the antibody-MRD fusions that decreases CDC include one or more modifications corresponding to: IgG1-S239D, A330L, I332E; IgG2 EU sequence 118-260; IgG4-EU sequence 261-447; IgG2-H268Q, V309L, A330S, A331S; IgG1-C226S, C229S, E233P, L234V, L235A; IgG1-L234F, L235E, P331S; and IgG1-C226S, P230S.

The half-life on an IgG is mediated by its pH-dependent binding to the neonatal receptor FcRn. In certain embodiments the antibody component of the antibody-MRD fusion has been modified to enhance binding to FcRn (see, e.g., Petkova et al., Int. Immunol. 18:1759-1769 (2006); Dall'Acqua et al., J. Immunol. 169:5171-5180 (2002); Oganesyan et al., Mol. Immunol. 46:1750-1755 (2009); Dall'Acqua et al., J. Biol. Chem. 281:23514-23524 (2006), Hinton et al., J. Immunol. 176:346-356 (2006); Datta-Mannan et al., Drug Metab. Dispos. 35:86-94 (2007); Datta-Mannan et al., J. Biol. Chem. 282:1709-1717 (2007); Int. Appl. Publ. No. WO2006/130834; Strohl, Curr. Op. Biotechnol. 20:685-691 (2009); and Yeung et al., J. Immunol. 182:7663-7671 (2009); each of which is herein incorporated by reference in its entirety).

In additional embodiments, the antibody of the antibody-MRD fusion has been modified to selectively bind FcRn at pH6.0, but not pH 7.4. Examples of Fc sequence engineering modifications contained in the antibody component of the antibody-MRD fusions that increases half-life include one or more modifications corresponding to: IgG1-M252Y, S254T, T256E; IgG1-T250Q, M428L; IgG1-H433K, N434Y; IgG1-N434A; and IgG1-T307A, E380A, N434A.

In other embodiments the antibody component of the antibody-MRD fusion has been modified to decrease binding to FcRn (see, e.g., Petkova et al., Int. Immunol. 18:1759-1769 (2006); Datta-Mannan et al., Drug Metab. Dispos. 35:86-94 (2007); Datta-Mannan et al., J. Biol. Chem. 282:1709-1717 (2007); Strohl, Curr. Op. Biotechnol. 20:685-691 (2009); and Vaccaro et al., Nat. Biotechnol. 23:1283-1288 (2005), each of which is herein incorporated by reference in its entirety). Examples of Fc sequence engineering modifications contained in the antibody component of the antibody-MRD fusions that decrease half-life include one or more modifications corresponding to: IgG1-M252Y, S254T, T256E; H433K, N434F, 436H; IgG1-I253A; and IgG1-P257I, N434H or D376V, N434H.

In some embodiments, the antibody-MRD fusions have been glyocoengineered or the Fc portion of the MRD-containing antibody has been mutated to increase effector function using techniques known in the art. For example, the inactivation (through point mutations or other means) of a constant region domain may reduce Fc receptor binding of the circulating modified antibody thereby increasing tumor localization. In other cases it may be that constant region modifications consistent with the instant invention moderate complement binding and thus reduce the serum half-life and nonspecific association of a conjugated cytotoxin. Yet other modifications of the constant region may be used to modify disulfide linkages or oligosaccharide moieties that allow for enhanced localization due to increased antigen specificity or antibody flexibility. The resulting physiological profile, bioavailability and other biochemical effects of the modifications, such as tumor localization, biodistribution and serum half-life, can easily be measured and quantified using well know immunological techniques without undue experimentation.

Methods for generating antibodies containing non-naturally occurring Fc regions are known in the art. For example, amino acid substitutions and/or deletions can be generated by mutagenesis methods, including, but not limited to, site-directed mutagenesis (Kunkel, Proc. Natl. Acad. Sci. USA 82:488-492 (1985)), PCR mutagenesis (Higuchi, in "PCR Protocols: A Guide to Methods and Applications", Academic Press, San Diego, pp. 177-183 (1990)), and cassette mutagenesis (Wells et al., Gene 34:315-323 (1985)). Site-directed mutagenesis can be performed by the overlap-extension PCR method (Higuchi, in "PCR Technology: Principles and Applications for DNA Amplification", Stockton Press, New York, pp. 61-70 (1989)). Alternatively, the technique of overlap-extension PCR (Higuchi, ibid.) can be used to introduce any desired mutation(s) into a target sequence (the starting DNA). Other methods useful for the generation of antibodies containing non-naturally occurring Fc regions are known in the art (see, e.g., U.S. Pat. Nos. 5,624,821, 5,885,573, 5,677,425, 6,165,745, 6,277,375, 5,869,046, 6,121,022, 5,624,821, 5,648,260, 6,528,624, 6,194,551, 6,737,056, 6,821,505 and 6,277,375; U.S. Appl. Publ. No. 2004/0002587 and Int Appl. Publ. Nos. WO94/29351, WO99/58572, WO00/42072, WO02/060919, WO04/029207, WO04/099249 and WO04/063351).

Multivalent and multispecific compositions (e.g., MRD-containing antibodies) used according to the methods of the invention also include derivatives that are modified, e.g., by the covalent attachment of any type of molecule to the antibody such that covalent attachment does not prevent the antibody from specifically binding to its cognate epitope. For example, but not by way of limitation, the antibody derivatives include antibodies that have been modified, e.g., by glycosylation, acetylation, pegylation, phosphorylation, amidation, or derivatization by known protecting/blocking groups. Any of numerous chemical modifications may be carried out by known techniques, including, but not limited to acetylation, formylation, etc. Additionally, the derivative may contain one or more non-classical amino acids.

According to some embodiments the antibody component of compositions of the invention is engineered to contain one or more free cysteine amino acids having a thiol reactivity within a desirable range (e.g., 0.6 to 1.0), wherein the cysteine engineered antibody is prepared by a process comprising replacing one or more amino acid residues of a parent antibody by cysteine. In some embodiments one or more free cysteine amino acid residues are located in a light chain. In additional embodiments one or more free cysteine amino acid residues are located in a heavy chain. In additional embodiments one or more free cysteine amino acid residues are located in a both the heavy and light chain. In some embodiments, the cysteine engineered MRD-containing antibody contains a free cysteine amino acid having a thiol reactivity value in the range of 0.6 to 1.0, and a sequence modification in the light chain or the heavy chain that is disclosed in U.S. Pat. No. 7,855,275. In other embodiments, the cysteine engineered antibody contains a free cysteine amino acid having a thiol reactivity value in the range of 0.6 to 1.0, and a sequence modification in the light chain or the heavy chain that is not disclosed in U.S. Pat. No. 7,855,275, the contents of which are herein incorporated by reference in its entirety.

In additional embodiments, the MRD-containing antibody is engineered to contain one or more free selenocysteine amino acids or another non-natural amino acid capable of forming disulfide bonds. Antibodies containing the same and methods for making such antibodies are known in the art. See, e.g., Hofer et al., Proc. Natl. Acad. Sci. 105(34):12451-12456 (2008); and Hofer et al., Biochem. 48(50):12047-12057 (2009), each of which is herein incorporated by reference in its entirety. In some embodiments one or more free selenocysteine amino acid residues are located in a light chain. In additional embodiments one or more free selenocysteine amino acid residues are located in a heavy chain. In additional embodiments one or more free selenocysteine amino acid residues are located in a both the heavy and light chain.

In certain embodiments, the multivalent and multispecific compositions (e.g., MRD-containing antibodies) have been modified so as to not elicit a deleterious immune response in the animal to be treated, e.g., in a human. In one embodiment, the antibody is modified to reduce immunogenicity using art-recognized techniques. For example, antibody components of the multivalent and multispecific compositions (e.g., MRD-containing antibodies) can be humanized, primatized, deimmunized, or chimerized. These types of antibodies are derived from a non-human antibody, typically a murine or primate antibody, that retains or substantially retains the antigen-binding properties of the parent antibody, but which is less immunogenic in humans. This may be achieved by various methods, including (a) grafting the entire non-human variable domains onto human constant regions to generate chimeric antibodies; (b) grafting at least a part of one or more of the non-human complementarity determining regions (CDRs) into human frameworks and constant regions with or without retention of critical framework residues; or (c) transplanting the entire non-human variable domains, but "cloaking" them with human-like sections by replacement of surface residues. Such methods are disclosed in Morrison et al., Proc. Natl. Acad. Sci. 81:6851-6855 (1984); Morrison et al., Adv. Immunol. 44:65-92 (1988); Verhoeyen et al., Science 239:1534-1536 (1988); Padlan, Molec. Immun. 28:489-498 (1991); Padlan, Molec. Immun. 31:169-217 (1994), and U.S. Pat. Nos. 5,585,089, 5,693,761, 5,693,762, and 6,190,370, each of which is herein incorporated by reference in its entirety.

De-immunization can also be used to decrease the immunogenicity of an MRD-containing antibody. As used herein, the term "de-immunization" includes alteration of an MRD-containing antibody to modify T cell epitopes (see, e.g., Int. Appl. Pub. WO9852976A1, and WO0034317A2, each if which is herein incorporated by reference in its entirety). For example, VH and VL sequences from the starting antibody are analyzed and a human T cell epitope "map" is generated from each V region showing the location of epitopes in relation to complementarity-determining regions (CDRs) and other key residues within the sequence. Individual T cell epitopes from the T cell epitope map are analyzed in order to identify alternative amino acid substitutions with a low risk of altering activity of the final antibody. A range of alternative VH and VL sequences are designed comprising combinations of amino acid substitutions and these sequences are subsequently incorporated into a range of antibodies for use in the diagnostic and treatment methods disclosed herein, which are then tested for function. Typically, between 12 and 24 variant antibodies are generated and tested. Complete heavy and light chain genes comprising modified V and human C regions are then cloned into expression vectors and the subsequent plasmids introduced into cell lines for the production of whole antibody. The antibodies are then compared in appropriate biochemical and biological assays, and the optimal variant is identified.

Many different antibody components of the multivalent and multispecific compositions (e.g., MRD-containing antibodies) can be used in the methods described herein. It is contemplated that catalytic and non-catalytic antibodies can be used in the present invention. For example, Antibody 38C2 is an antibody-secreting hybridoma and has been previously described in Int. Appl. Pub. WO97/21803. 38C2 contains an antibody combining site that catalyzes the aldol addition reaction between an aliphatic donor and an aldehyde acceptor. In a syngeneic mouse model of neuroblastoma, systemic administration of an etoposide prodrug and intra-tumor injection of Ab 38C2 inhibited tumor growth.

The antibody target of the MRD-containing antibody (i.e., the target of the antigenic binding domain) can be any molecule that it is desirable for a MRD-antibody fusion to interact with. For example, the antibody target can be a soluble factor or the antibody target can be a transmembrane protein, such as a cell surface receptor. The antibody target can also be an extracellular component or an intracellular component. In certain embodiments, the antibody target is a factor that regulates cell proliferation, differentiation, or survival. In other embodiments, the antibody target is a cytokine. In another nonexclusive embodiment, the antibody target is a factor that regulates angiogenesis. In another nonexclusive embodiment, the antibody target is a factor that regulates one or more immune responses, such as, autoimmunity, inflammation and immune responses against cancer cells. In another nonexclusive embodiment, the antibody target is a factor that regulates cellular adhesion and/or cell-cell interaction. In certain nonexclusive embodiments, the antibody target is a cell signaling molecule. The ability of an antibody to bind to a target and to block, increase, or interfere with the biological activity of the antibody target can be determined using or routinely modifying assays, bioassays, and/or animal models known in the art for evaluating such activity.

In some embodiments the antibody target of the MRD-containing antibody is a disease-related antigen. The antigen can be an antigen characteristic of a particular cancer, and/or of a particular cell type (e.g., a hyperproliferative cell), and/or of a particular pathogen (e.g., a bacterial cell (e.g., tuberculosis, smallpox, anthrax)), a virus (e.g., HIV), a parasite (e.g., malaria, leichmaniasis), a fungal infection, a mold, a mycoplasm, a prion antigen, or an antigen associated with a disorder of the immune system.

In some embodiments, the antibody target of the MRD-containing antibody is a target that has been validated in an animal model or clinical setting.

In other embodiments, the antibody target of the MRD-containing antibody is a cancer antigen.

In one embodiment, the antibody target of the MRD-containing antibody is: PDGFRA, PDGFRB, PDGF-A, PDGF-B, PDGF-CC, PDGF-C, PDGF-D, VEGFR1, VEGFR2, VEGFR3, VEGFC, VEGFD, neuropilin 2 (NRP2), betacellulin, PLGF, RET (rearranged during transfection), TIE1, TIE2 (TEK), CA125, CD3, CD4, CD7, CD10, CD13, CD25, CD32, CD32b, CD44, CD49e (integrin alpha 5), CD55, CD64, CD90 (THY1), CD133 (prominin 1), CD147, CD166, CD200, ALDH1, ESA, SHH, DHH, IHH, patched1 (PTCH1), smoothened (SMO), WNT1, WNT2B, WNT3A, WNT4, WNT4A, WNT5A, WNT5B, WNT7B, WNT8A, WNT10A, WNT10B, WNT16B, LRP5, LRP6, FZD1, FZD2, FZD4, FZD5, FZD6, FZD7, FZD8, Notch, Notch1, Notch3, Notch4, DLL4, Jagged, Jagged1, Jagged2, Jagged3, TNFSF1 (TNFb, LTa), TNFRSF1A (TNFR1, p55, p60), TNFRSF1B (TNFR2), TNFSF6 (Fas Ligand), TNFRSF6 (Fas, CD95), TNFRSF6 (DcR3), TNFSF7 (CD27 Ligand, CD70), TNFRSF7 (CD27), TNFSF8 (CD30 Ligand), TNFRSF8 (CD30), TNFSF11 (RANKL), TNFRSF11A (RANK), TNFSF12 (TWEAK), TNFRSF12 (TWEAKR), TNFSF13 (APRIL), TNFSF13B (BLYS), TNFRSF13B (TACI), TNFRSF13C (BAFFR), TNFSF15 (TL1A), TNFRSF17 (BCMA), TNFRSF19L (RELT), TNFRSF19 (TROY), TNFRSF21 (DR6), TNFRSF25 (DR3), ANG1 (ANGPT1), ANG3 (ANGPTL1), ANG4 (ANGPT4), IL1 alpha, IL1 beta, IL1R1, IL1R2, IL2, IL2R, IL5, IL5R, IL6, IL6R, IL8, IL8R, IL10, IL10R, IL12, IL12R, IL13, IL13R, IL15, IL15R, IL18, IL18R, IL19, IL19R, IL21R, IL23, IL23R, mif, XAG1, XAG3, REGIV, FGF1, FGF2, FGF3, FGF4, FGFR1, FGFR2, FGFR3, ALK, ALK1, ALK7, ALCAM, Artemin, Axl, TGFb, TGFb2, TGFb3, TGFBR1, IGFIIR, BMP2, BMP5, BMP6, BMPRI, GDF3, GDF8, GDF9, N-cadherin, E-cadherin, VE-cadherin, NCAM, LICAM (CD171), ganglioside GM2, ganglioside GD2, calcitonin, PSGR, DCC, DCCP1, CXCR2, CXCR7, CCR3, CCR5, CCR7, CCR10, CXCL1, CXCL5, CXCL6, CXCL8, CXCL12, CCL3, CCL4, CCL5, CCL11, Claudin1, Claudin2, Claudin3, Claudin4, TMEFF2, neuregulin, MCSF, CSF, CSFR (fms), GCSF, GCSFR, BCAM, HPV, hCG, SR1F, PSA, FOLR2 (folate receptor beta), BRCA1, BRCA2, HLA-DR, ABCC3, ABCB5, HM1.24, LFA1, LYNX, S100A8, S100A9, SCF, Von Willebrand factor, Lewis Y6 receptor, Lewis Y, CA G250 (CA9), integrin avb3 (CNTO95), integrin avb5, activin B1 alpha, leukotriene B4 receptor (LTB4R), neurotensin NT receptor (NTR), 5T4 oncofetal antigen, Tenascin C, MMP, MMP2, MMP7, MMP9, MMP12, MMP14, MMP26, cathepsin G, cathepsin H, cathepsin L, SULF1, SULF2, MET, UPA, MHC1, MN (CA9), TAG-72, TM4SF1, Heparanase (HPSE), syndecan (SDC1), Ephrin B2, Ephrin B4, or relaxin2. In another embodiment, the antibody target of the MRD-containing antibody is CD137, CD137L, CD152, CD160, CD272, CD273, CD274, CD275 (ICOSL), CD276, CD276 receptor, CD278 (ICOS), CD279, B7-H4, B7H4 receptor, CXCL9, CXCL10, CXCL11, CCL17, CCL21, CCL22, IL35, TNFRSF10b (DR5), or GUC2c (MECIL). An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. The above antibody and MRD targets and those otherwise described herein are intended to be illustrative and not limiting.

In another embodiment, the antibody target of the MRD-containing antibody is CD19, CD22, CD30, CD33, CD38, CD44v6, TNFSF5 (CD40 Ligand), TNFRSF5 (CD40), CD52, CD54 (ICAM), CD74, CD80, CD200 EPCAM (EGP2), neuropilin 1 (NRP1), TEM1, mesothelin, TGFbeta 1, TGFBRII, phosphatidlyserine, folate receptor alpha (FOLR1), TNFRSF10A (TRAIL R1 DR4), TNFRSF10B (TRAIL R2 DR5), CXCR4, CCR4, CCL2, HGF, CRYPTO, VLA5, TNFSF9 (41BB Ligand), TNFRSF9 (41BB), CTLA4, HLA-DR, IL6, TNFSF4 (OX40 Ligand), TNFRSF4 (OX40), MUC1, MUC18, mucin CanAg, ganglioside GD3, EGFL7, PDGFRa, IL21, IGF1, IGF2, CD117 (cKit), PSMA, SLAMF7, carcinoembryonic antigen (CEA), FAP, integrin avb3, or integrin $\alpha 5\beta 3$. In an additional embodiment, the antibody target of the MRD-containing antibody is CD70, LAG3 or KIR. An MRD that binds to one of the above targets are encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention.

In particular embodiments, the antibody of the MRD-containing antibody competes for target binding with an antibody selected from: siplizumab CD2 (e.g., MEDI-507, MedImmune), blinatumomab CD19 CD3 (e.g., MT103, Micromet/MedImmune); XMAB®5574 CD19 (Xencor), SGN-19A CD19 (Seattle Genetics), ASG-5ME (Agenesys and Seattle Genetics), MEDI-551 CD19 (MedImmune), epratuzumab CD22 (e.g., hLL2, Immunomedics/UCB), inotuzumab ozogamicin CD22 (Pfizer), iratumumab CD30 (e.g., SGN-30 (Seattle Genetics) and MDX-060 (Medarex)), XMAB®2513 CD30 (Xencor), brentuximab vedotin CD30 (e.g., SGN-35, Seattle Genetics), gemtuzumab ozogamicin CD33 (e.g., MYLOTARG®, Pfizer), lintuzumab CD33 (e.g., antibody of Seattle Genetics), MOR202, CD38 (MorphoSys), daratumumab CD38 (e.g., Genmab antibody), CP870893 CD40 (Pfizer), dacetuzumab CD40 (e.g., SGN40, Seattle Genetics), ANTOVA® CD40 (Biogen Idec), lucatumumab CD40 HCD122, Novartis) XMAB®5485 CD40 (Xencor), teneliximub, ruplizumab CD40L (e.g., ANTOVA®) bivatuzumab mertansine CD44v6, alemtuzumab CD52 (e.g., CAMPATH®/MABCAMPATH®, Genzyme/Bayer), BI505 ICAM1 (Bioinvent), milatuzumab CD74 (e.g., antibody of Immunomedics), galiximab CD80

(Biogen Idec), BMS663513 4-1BB (Bristol-Myers Squibb), Alexion CD200 antibody (Alexion), edrecolomab EPCAM (e.g., MAb17-1A, PANOREX® (GlaxoSmithKline), AT003 EPCAM (Affitech)), adecatumumab EPCAM (e.g., MT201, Micromet), oportuzumab monatox EPCAM, Genentech anti-NRP1 antibody, MORAB004 TEM1 (Morphotek), MORAB009 mesothelin (Morphotek), lerdelimumab TGFb1 (e.g., CAT-152, Cambridge Antibody Technology), metelimumab TGFb1 (e.g., CAT-192, Cambridge Antibody Technology), ImClone anti-TGFBRII antibody, bavituximab phosphatidylserine (e.g., antibody of Peregrine (Peregrine Pharmaceuticals)), AT004 phosphatidylserine (Affitech), AT005 phosphatidylserine (Affitech), MORAB03 folate receptor alpha (Morphotek), farletuzumab folate receptor alpha cancer (e.g., MORAB003, Morphotek), CS1008 DR4 (Sankyo), mapatumumab DR4 (e.g., HGS-ETR1, Human Genome Sciences), LBY135 DR5 (Novartis), AMG66 DR5 (Amgen), Apomab DR5 (Genentech), PRO95780 (Genentech), lexatumumab DR5 (e.g., HGS-ETR2, Human Genome Sciences), conatumumab DR5 (e.g., AMG655, Amgen), tigatuzumab DR5 (e.g., CS-1008), AT009 CXCR4 (Affitech), AT008 CCR4 (Affitech), CNTO-888 CCL2 (Centocor), AMG102 HGF (Amgen), CRYPTO antibody (Biogen Idec), M200 antibody VLA5 (Biogen Idec), ipilimumab CTLA4 (e.g., MDX-010, Bristol-Myers Squibb/Medarex), belatacept CTLA4 ECD (e.g., CP-675,206, Pfizer), IMMU114 HLA-DR (Immunomedics), apolizumab HLA-DR, toclizumab IL6R (e.g., ACTEMR®A/ROAC-TREMRA®, Hoffman-La Roche), OX86 OX40, pemtumomab PEM/MUC1 (Theragyn), ABX-MA1 MUC-18 (Abgenix), clivatuzumab MUC-18 (e.g., hPAM4, Immunomedics), cantuzumab mertansine mucin CanAg, ecromeximab (Ludwig Institute), Genentech anti-EGFL7 antibody, AMG820 CSFR (Amgen), olaratumab PDGFRa (e.g., antibody of Imclone (Imclone)), IL21 antibody Zymogenetics (Zymogenetics), MEDI-573 IGF1/IGF2 (MedImmune), AMG191 cKit (Amgen), etaracizumab (e.g., MEDI-522, MedImmune), and MLN591 PSMA (Millennium Pharmaceuticals), elotuzumab SLAMF7 (e.g., HuLuc63, BMS), labetuzumab CEA (CEA-CIDE®, Immunomedics), sibrotuzumab FAP, CNTO95 integrin avb3 (Centocor), VITAXIN® integrin avb3 (MedImmune), and voloximab α5β1 (antibody targets are italicized). MRDs that compete for target binding with one of the above antibodies are encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention.

In additional embodiments, the antibody of the MRD-containing antibody competes for target binding with an antibody selected from: MDX-1342 CD19 (BMS), SGN-CD19A CD19 (Seattle Genetics), an anti-CD20 antibody described in U.S. Pat. No. 5,500,362, ofatumumab CD20 (e.g., ARZERRA®, GENMAB), veltuzumab CD20 (hA20, Takeda and Nycomed), PRO70769 CD20 (Genentech; see e.g., Intl. Appl. No. PCT/US2003/040426), AMG780 Tie2/Ang1 (Amgen), REGN910 ANG2 (Regeneron), and anti-CD22 antibody described in U.S. Pat. No. 5,789,554 (Immunomedics), lumiliximab CD23 (e.g., IDEC152, Biogen), IDEC-152 CD23 (Biogen), MDX-1401 CD30 (BMS), HeFi-1 CD30 (NCI), daratumumab CD38, an anti CD-40 antibody described in Intl. Appl. No. WO2007124299 (Novartis), IDEC-131 CD40L (Biogen), MDX-1411 CD70 (BMS), SGN-75 CD70 ADC (Seattle Genetics), HuMax-CD74™ CD74 ADC (Genmab), IDEC-114 CD80 (Biogen), TRC105 CD105/endoglin (Tracon), ABX-CBL CD147 (Amgen), RG1HuMax-TF™ Tissue Factor (TF) (Genmab), HuMax-Her2™ ErbB2 (Genmab), Trastuzumab-DM1 ErbB2-DM1 (Genentech), AMG888 HER3 (Amgen and Daiichi Sankyo), HuMV833 VEGF (Tsukuba Research Lab, see, e.g., Intl. Appl. Publ. No. WO/2000/034337), IMC-18F1 VEGFR1 (Imclone), IMC-1C11 VEGFR (Imclone), DC101 VEGFR2 (Imclone), KSB-102 EGFR (KS Biomedix), mAb-806 EGFR (Ludwig Institute for Cancer Research), MR1-1 EGFRvIII toxin (IVAX, National Cancer Institute), HuMax-EGFR EGFR (Genmab, see, e.g., U.S. application Ser. No. 10/172,317), IMC-11F8 EGFR (Imclone), CDX-110 EGFRvIII (AVANT Immunotherapeutics), zalumumab EGFR (Genmab), 425, EMD55900 and EMD62000 EGFR (Merck KGaA, see, e.g., U.S. Pat. No. 5,558,864), ICR62 EGFR (Institute of Cancer Research, see, e.g., Intl. Appl. Publ. No. WO95/20045), SC100 EGFR (Scancell and ISU Chemical), MOR201 FGFR-3 (Morphosys), ARGX-111 c-Met (arGEN-X), HuMax-cMet™ cMet (Genmab), GC-1008 TGEb1 (Genzyme), MDX-070 PMSA (BMS), huJ591 PSMA (Cornell Research Foundation), muJ591 PSMA (Cornell Research Foundation), GC1008 TGFb (Genzyme), NG-1 Ep-CAM (Xoma), MOR101 ICAM-1 (CD54) (Morphosys), MOR102 ICAM-1 (CD54) (Morphosys), ABX-MA1 MUC18 (Abgenix), HumaLYM (Intracel), HumaRAD-HN (Intracel), HumaRAD-OV (Intracel), ARGX-110 and ARGX-111 (arGEN-X), HuMax-Lymphoma (Genmab and Amgen), Milatuzumab CD74 (e.g., IMMU-115, IMMU-110; Immunomedics), HuMax-Cancer Heparanase I (Genmab), Hu3S193 Lewis (y) (Wyeth, Ludwig Institute of Cancer Research), RAV12 N-linked carbohydrate epitope (Raven), nimotuzumab (TheraCIM, hR3; YM Biosciences, see, e.g., U.S. Pat. Nos. 5,891,996 and 6,506,883), BEC2 GD3 (Imclone), $^{90}$Ytacatuzumab tetraxetan alpha fetoprotein (e.g., FP-CIDE®, Immunomedics), KRN330 (Kirin), huA33 A33 (Ludwig Institute for Cancer Research), mAb 216 B cell glycosylated epitope (NCI), REGN421 DLL4 (Regeneron), ASG-5ME SLC44A4 ADC (AGS-5), ASG-22ME Nectin-4 ADC, CDX-1307 (MDX-1307), hCGb (Celldex), parathyroid hormone-related protein (PTH-rP) (UCB), MT293 cleaved collagen (TRC093/D93, Tracon), KW-2871 GD3 (Kyowa), KIR (1-7F9) KIR (Novo), A27.15 transferrin receptor (Salk Institute, see, e.g., Intl. Appl. Publ. No. WO2005/111082) and E2.3 transferrin receptor (Salk Institute). MRDs that compete for target binding with one of the above antibodies are encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention. In additional embodiments, one of the above-described antibodies is the antibody of the MRD-containing antibody.

In particular embodiments, the antibody of the MRD-containing antibody is an antibody selected from: siplizumab CD2 (e.g., MEDI-507, MedImmune), blinatumomab CD19 CD3 (e.g., MT103, Micromet/MedImmune); XMAB®5574 CD19, (Xencor), SGN-19A CD19 (Seattle Genetics), ASG-5ME (Agenesys and Seattle Genetics), MEDI-551 CD19 (MedImmune), epratuzumab CD22 (e.g., hLL2, Immunomedics/UCB), inotuzumab ozogamicin CD22, iratumumab CD30 (e.g., SGN-30 (Seattle Genetics) and MDX-060 (Medarex)), XMAB®2513 CD30 (Xencor), brentuximab vedotin CD30 (e.g., SGN-35, Seattle Genetics), gemtuzumab ozogamicin CD33 (e.g., MYLOTARG®, Pfizer), lintuzumab CD33 (e.g., antibody of Seattle Genetics), MOR202 CD38 MorphoSys), daratumumab CD33 (e.g., Genmab antibody), CP870893 CD40 (Pfizer), dacetuzumab CD40 (e.g., SGN40, Seattle Genetics), ANTOVA® CD40 (Biogen Idec), lucatumumab CD40 (e.g., FWD 122, Novartis) XMAB®5485 CD40 (Xencor), teneliximab, ruplizumab CD40L (e.g., ANTOVA®), bivatuzumab mertansine CD44v6, alemtuzumab CD52 (e.g., CAMPATH®/MAB-CAMPATH®, Genzyme/Bayer), BI505 ICAM1 (Bioinvent), milatuzumab CD74 (e.g., antibody of Immunomedics), galiximab CD80 (Biogen Idec), BMS663513 4-1BB (Bristol-Myers Squibb), Alexion CD200 antibody (Alexion), edrecolomab EPCAM (e.g., MAb17-1A, PANOREX® (GlaxoSmithKline), AT003 EPCAM (Affitech)), adecatumumab EPCAM (e.g., MT201, Micromet), oportuzumab monatox EPCAM, Genentech anti-NRP1 antibody, MORAB004 TEM1 (Morphotek), MORAB009 mesothelin (Morphotek), lerdelimumab TGFb1 (e.g., CAT-152, Cambridge Antibody Technology), metelimumab TGFb1 (e.g., CAT-192, Cambridge Antibody Technology), ImClone anti-TGFBRII antibody, bavituximab phosphatidylserine (e.g., antibody of Peregrine (Peregrine Pharmaceuticals)), AT004 phosphatidylserine (Affitech), AT005 phosphatidylserine (Affitech), MORAB03 folate receptor alpha (Morphotek), farletuzumab folate receptor alpha cancer (e.g., MORAB003, Morphotek), CS1008 DR4 (Sankyo), mapatumumab DR4 (e.g., HGS-ETR1, Human Genome Sciences), LBY135 DR5 (Novartis), AMG66 DR5 (Amgen), Apomab DR5 (Genentech), PRO95780 (Genentech), lexatumumab DR5 (e.g., HGS-ETR2, Human Genome Sciences), conatumumab DR5 (e.g., AMG655, Amgen), tigatuzumab (e.g., CS-1008), AT009 CXCR4 (Affitech), AT008 CCR4 (Affitech), CNTO-888 CCL2 (Centocor), AMG102 HGF (Amgen), CRYPTO antibody (Biogen Idec), M200 antibody VLA5 (Biogen Idec), ipilimumab CTLA4 (e.g., MDX-010, Bristol-Myers Squibb/Medarex), belatacept CTLA4 ECD (e.g., CP-675,206, Pfizer), IMMU114 HLA-DR (Immunomedics), apolizumab HLA-DR, toclizumab IL6R (e.g., ACTEMR®A/ROACTREMRA®, Hoffman-La Roche) OX86 OX40, pemtumomab PEM/MUC1 (Theragyn), ABX-MA1 MUC-18 (Abgenix), cantuzumab mertansine mucin. CanAg, ecromeximab (Ludwig Institute), Genentech anti-EGFL7 antibody, AMG820 CSFR (Amgen), olaratumab PDGFRa (e.g., antibody of Imclone (Imclone)), IL21 antibody Zymogenetics (Zymogenetics), MEDI-573 IGF1/IGF2 (MedImmune), AMG191 cKit (Amgen), etaracizumab (e.g., MEDI-522, MedImmune), MLN591 PSMA (Millennium Pharmaceuticals), elotuzumab SLAMF7 (e.g., HuLuc63, PDL), labetuzumab CEA (CEA-CIDE®, Immunomedics), sibrotuzumab FAP, CNTO95 integrin avb3 (Centocor), VITAXIN® integrin avb3 (MedImmune), and voloximab α5β1 (e.g., M200, PDL and Biogen Idec).

In an additional embodiment, the antibody target of the MRD-containing antibody is ALK1. In one embodiment, the antibody is PF-3,446,962 (Pfizer). In another embodiment, the antibody binds to the same epitope as PF-3,446,962. In a further embodiment, the antibody competitively inhibits binding of PF-3,446,962 to ALK1. Multivalent and multispecific compositions (e.g., MRD-containing antibodies) having 1, 2, 3, 4, 5, 6, or more MRDs that compete for ALK1 binding with PF-3,446,962 are also encompassed by the invention.

In an additional embodiment, the antibody target of the MRD-containing antibody is CD22. In one embodiment, the antibody is inotuzumab (e.g., inotuzumab ozogamicin CMC-544, PF-5,208,773; Pfizer). In one embodiment, the antibody binds to the same epitope as inotuzumab. In another embodiment, the antibody competitively inhibits binding of inotuzumab to CD22. Multivalent and multispecific compositions (e.g., MRD-containing antibodies) having 1, 2, 3, 4, 5, 6, or more MRDs that compete for CD22 binding with inotuzumab are also encompassed by the invention.

In an additional embodiment, the antibody target of the MRD-containing antibody is CRYPTO. In one embodiment, the antibody is the Biogen CRYPTO antibody that has advanced to phase I clinical trials (Biogen Idec). In another embodiment, the antibody binds to the same epitope as the Biogen CRYPTO antibody. In a further embodiment, the antibody competitively inhibits binding of the Biogen CRYPTO antibody to CRYPTO. Multivalent and multispecific compositions (e.g., MRD-containing antibodies) having 1, 2, 3, 4, 5, 6, or more MRDs that compete for CRYPTO binding with the Biogen CRYPTO antibody are also encompassed by the invention.

In an additional embodiment, the antibody target of the MRD-containing antibody is TNFSF5 (CD40 LIGAND). In one embodiment, the antibody is the Biogen CD40L antibody that has advanced to phase I clinical trials (Biogen Idec). In another embodiment, the antibody binds to the same epitope as the Biogen CD40L antibody. In a further embodiment, the antibody competitively inhibits binding of the Biogen CD40L antibody to CD40L. Multivalent and multispecific compositions (e.g., MRD-containing antibodies) having 1, 2, 3, 4, 5, 6, or more MRDs that compete for CD40L binding with the Biogen CD40L antibody are also encompassed by the invention.

In an additional embodiment, the antibody target of the MRD-containing antibody is CD80. In one embodiment, the antibody is galiximab (Biogen Idec). In another embodiment, the antibody binds to the same epitope as galiximab. In a further embodiment, the antibody competitively inhibits binding of galiximab to CD80. Multivalent and multispecific compositions (e.g., MRD-containing antibodies) having 1, 2, 3, 4, 5, 6, or more MRDs that compete for CD80 binding with galiximab are also encompassed by the invention.

In additional embodiments, an MRD-containing antibody binds CD80 and a target selected from: CD2, CD3, CD4, CD19, CD20, CD22, CD23, CD30, CD33, TNFRSF5 (CD40), CD52, CD74, TNFRSF10A (DR4), TNFRSF10B (DR5), VEGFR1, VEGFR2 and VEGF. In additional embodiments, an MRD-containing antibody binds CD80 and a target selected from: CD3, CD4 and NKG2D. Multivalent and multispecific compositions (e.g., MRD-containing antibodies) that bind CD80 and also at least bind 2, 3, 4, 5 or more of these targets are also encompassed by the invention. In specific embodiments, the antibody component of the MRD-containing antibody binds CD80. In further embodiments, the antibody component of the MRD-containing antibody is galiximab. In a further embodiment, the antibody of the MRD-containing antibody binds a molecule on the surface of a cell and MRDs of the MRD-containing antibody binds TNFRSF10B (DR5) through one or more epitopes with a valency of 2, 3, 4, 5, 6, 7, 8, 9, 10, or more.

In an additional embodiment, the antibody target of the MRD-containing antibody is MCSF. In one embodiment, the antibody is PD-360,324 (Pfizer). In another embodiment, the antibody binds to the same epitope as PD-360,324. In a further embodiment, the antibody competitively inhibits binding of PD-360,324 to MCSF. Multivalent and multispecific compositions (e.g., MRD-containing antibodies) having 1, 2, 3, 4, 5, 6, or more MRDs that compete for MCSF binding with PD-360,324 are also encompassed by the invention.

In an additional embodiment, the antibody target of the MRD-containing antibody is CD44. In one embodiment, the antibody is PF-3,475,952 (Pfizer). In another embodiment, the antibody binds to the same epitope as PF-3,475,952. In a further embodiment, the antibody competitively inhibits binding of PF-3,475,952 to CD44. Multivalent and multispecific compositions (e.g., MRD-containing antibodies) having 1, 2, 3, 4, 5, 6, or more MRDs that compete for CD44 binding with PF-3,475,952 are also encompassed by the invention.

In an additional embodiment, the antibody target of the MRD-containing antibody is p-cadherin (CDH3). In one embodiment, the antibody is PF-3,732,010 (Pfizer). In another embodiment, the antibody binds to the same epitope as PF-3,732,010. In a further embodiment, the antibody competitively inhibits binding of PF-3,732,010 to p-cadherin. Multivalent and multispecific compositions (e.g., MRD-containing antibodies) having 1, 2, 3, 4, 5, 6, or more MRDs that compete for p-cadherin binding with PF-3,732,010 are also encompassed by the invention.

In another embodiment, the antibody target of the MRD-containing antibody is ANG2 (ANGPT2). In one embodiment, the antibody is MEDI3617 (MedImmune). In one embodiment, the antibody binds to the same epitope as MEDI3617. In another embodiment, the antibody competitively inhibits binding of MEDI3617 to ANG2. Multivalent and multispecific compositions (e.g., MRD-containing antibodies) having 1, 2, 3, 4, 5, 6, or more MRDs that compete for ANG2 binding with MEDI3617 are also encompassed by the invention.

In other embodiments, the antibody component of the MRD-containing antibody is an ANG-2 binding antibody disclosed in U.S. Pat. Nos. 7,063,965, 7,063,840, 6,645,484, 6,627,415, 6,455,035, 6,433,143, 6,376,653, 6,166,185, 5,879,672, 5,814,464, 5,650,490, 5,643,755, 5,521,073; U.S. Appl. Publ. Nos. 2011/0158978 (e.g., H4L4), 2006/0246071, 2006/0057138, 2006/0024297, 2006/0018909, 2005/0100906, 2003/0166858, 2003/0166857, 2003/0124129, 2003/0109677, 2003/0040463 and 2002/0173627; or Intl. Appl. Publ. Nos. WO2006/020706, WO2006/045049, WO2006/068953, or WO2003/030833 (the disclosure of each of which is herein incorporated by reference in its entirety). Multivalent and multispecific compositions (e.g., MRD-containing antibodies) having 1, 2, 3, 4, 5, 6, or more MRDs that compete for ANG2 binding with these antibodies are also encompassed by the invention.

In another embodiment, an MRD-containing antibody binds ANG2 and additionally binds a target selected from: VEGF (i.e., VEGFA), VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNF, FGFR3, EFNa1, EFNa2, ANG1, ANG2, IL1, IL1beta, IL6, IL8, IL18, HGF, PDGFA, PLGF, PDGFB, CXCL12, KIT, GCSF, CXCR4, PTPRC, TIE2, VEGFR1, VEGFR2, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind ANG2 and at least 1, 2, 3, 4, 5 or more of these targets are also encompassed by the invention. In further embodiments, the antibody component of the MRD-containing antibody is MEDI3617, AMG780 or REGN910. In further embodiments, the antibody component of the MRD-containing antibody is H4L4.

In particular embodiments, the MRD-containing antibody binds ANG2 and TNF. In additional embodiments, the MRD-containing antibody binds ANG2 and IL6. In other embodiments, the MRD-containing antibody binds ANG2 and IL1. In further embodiments, the administered MRD-containing antibody binds ANG2, IL6 and TNF. In further embodiments, the administered MRD-containing antibody binds ANG2, IL1 and TNF. In further embodiments, the MRD-containing antibody binds ANG2, IL1, 1L6 and TNF.

In particular embodiments, the MRD-containing antibody binds ANG2 and TNF and the antibody component of the MRD-containing antibody is adalimumab. In another embodiment, the MRD-containing antibody competes with adalimumab for binding to TNF.

In additional embodiments, the antibody component of the MRD-containing antibody binds ANG2. In further embodiments, the antibody component of the MRD-containing antibody is an ANG2 binding antibody selected from SAITAng-2-1, SAITAng-2-2, SAITAng-2-3, SAITAng-2-4 or another antibody disclosed in Intl. Appl. Publ. No. WO2009/142460. Multivalent and multispecific compositions (e.g., MRD-containing antibodies) having an antibody and/or 1, 2, 3, 4, 5, 6, or more MRDs that compete for ANG2 binding with one or more of these antibodies are also encompassed by the invention.

In additional embodiments, the antibody component of the MRD-containing antibody binds TIE2. In further embodiments, the antibody component of the MRD-containing antibody is a TIE2 binding antibody disclosed in U.S. Pat. Nos. 6,365,154 and 6,376,653; U.S. Appl. Publ. Nos. 2007/0025993, 2006/0057138 and 2006/0024297; or Intl. Appl. Publ. Nos. WO2006/020706, WO2000/018437 and WO2000/018804 (the disclosure of each of which is herein incorporated by reference in its entirety). Multivalent and multispecific compositions (e.g., MRD-containing antibodies) having an antibody and/or 1, 2, 3, 4, 5, 6, or more MRDs that compete for TIE binding with one or more these antibodies are also encompassed by the invention.

In certain embodiments, the antibody target of the MRD-containing antibody is EGFR(ErbB1), ErbB2, ErbB3, ErbB4, CD20, insulin-like growth factor-I receptor, prostate specific membrane antigen, an integrin, or cMet.

In one embodiment, the antibody in the MRD-containing antibody specifically binds EGFR(ErbB1). In a specific embodiment, the antibody is ERBITUX® (IMC-C225). In one embodiment, the antibody binds to the same epitope as ERBITUX®. In another embodiment, the antibody competitively inhibits binding of ERBITUX® to EGFR. In another embodiment, the antibody in the MRD-containing antibody inhibits EGFR dimerization. In another specific embodiment, the antibody is matuzumab (e.g., EMD 72000, Merck Serono) or panitumumab (e.g., VECTIBIX®, Amgen). In another embodiment, the antibody binds to the same epitope as matuzumab or panitumumab. In another embodiment, the antibody competitively inhibits binding of matuzumab or panitumumab to EGFR. In another embodiment, the antibody is ABX-EGF (Immunex) or MEDX-214 (Medarex). In another embodiment, the antibody binds to the same epitope as ABX-EGF or MEDX-214. In another embodiment, the antibody competitively inhibits binding of ABX-EGF or MEDX-214 to EGFR. In another specific embodiment, the antibody is zalutumumab (Genmab) or nimotuzumab (Biocon). In an additional embodiment, the antibody binds to the same epitope as zalutumumab (Genmab) or nimotuzumab (Biocon). In another embodiment, the antibody competitively inhibits binding of zalutumumab (Genmab) or nimotuzumab (Biocon) to EGFR.

In one embodiment, an MRD-containing antibody binds EGFR(ErbB1) and a target selected from: HGF, CD64, CDCP1, RON, cMET, ErbB2, ErbB3, IGF1R, PLGF, RGMa, PDGFRa, PDGFRb, VEGFR1, VEGFR2, TNFRSF10A (DR4), TNFRSF10B (DR5), IGF1,2, IGF2, CD3, CD4, NKG2D and tetanus toxoid. In some embodiments, the multivalent and monovalent multispecific composition (e.g., MRD-containing antibodies) binds at least 1, 2, 3, 4, 5 or more of these targets. In specific embodiments, the antibody component of the MRD-containing antibody binds EGFR. In further embodiments, the antibody component of the MRD-containing antibody is matuzumab, panitumumab, MEDX-214, or ABX-EGF. In further embodiments, the antibody component of the MRD-containing antibody is nimotuzumab (Biocon) or zalutumumab. In specific embodiments, the antibody component of the MRD-containing antibody is Erbitux®.

In specific embodiments, the MRD containing antibody binds ErbB1 and additionally binds ErbB3. In some embodiments, the antibody component of the MRD-containing antibody binds ErbB1 and an MRD of the MRD-containing antibody binds ErbB3. In a particular embodiment, the antibody component of the MRD-containing antibody is cetuximab. In additional embodiments, the antibody component of the MRD-containing antibody competes for ErbB1-binding with cetuximab. In another embodiment, the antibody in the MRD-containing antibody is an ErbB1-binding antibody selected from: nimotuzumab (Biocon), matuzumab (Merck KGaA), panitumumab (Amgen), zalutumumab (Genmab), MEDX-214, and ABX-EGF. In additional embodiments, the antibody component, MRD component and/or MRD-containing antibody competes for ErbB1-binding with an antibody selected from: nimotuzumab, matuzumab, panitumumab, and zalutumumab. In other embodiments, the antibody component of the MRD-containing antibody binds ErbB3 and an MRD of the MRD-containing antibody binds ErbB1 In additional embodiments, the antibody component of the MRD-containing antibody is an ErbB3-binding antibody selected from MM121 (Merrimack), 8B8 (Genentech), AV203 (Aveo), and AMG888 (Amgen). In additional embodiments, the antibody component, MRD component and/or MRD-containing antibody competes for ErbB3 binding with an antibody selected from MM121, 8B8, AV203, and AMG888.

In one embodiment the MRD-containing antibody specifically binds ErbB2 (Her2). In a specific embodiment, the antibody is trastuzumab (e.g., HERCEPTIN®, Genentech/Roche). In one embodiment, the antibody binds to the same epitope as trastuzumab. In another embodiment, the antibody competitively inhibits binding of trastuzumab to ErbB2. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention Thus, the invention encompasses MRD-containing antibodies comprising at least 1, 2, 3, 4, 5, 6, or more MRDs that compete for target binding with at least 1, 2, 3, 4, 5, 6 of the above antibodies.

In other embodiments, the antibody in the MRD-containing antibody specifically binds to ErbB2. In one embodiment, the antibody in the MRD-containing antibody is an antibody that specifically binds to the same epitope as the anti-ErbB2 antibody trastuzumab (e.g., HERCEPTIN®, Genentech). In another embodiment, the antibody in the MRD-containing antibody is an antibody that competitively inhibits ErbB2-binding by the anti-ErbB2 antibody trastuzumab. In yet another embodiment, the antibody in the MRD-containing antibody is the anti-ErbB2 antibody trastuzumab. In another embodiment, the antibody in the MRD-containing antibody inhibits HER2 dimerization. In another embodiment, the antibody in the MRD-containing antibody inhibits HER2 heterodimerization with HER3 (ErbB3). In a specific embodiment, the antibody is pertuzumab (e.g., OMNITARG® and phrMab2C4, Genentech). In another embodiment, the antibody specifically binds to the same epitope as pertuzumab. In another embodiment, the antibody in the MRD-containing antibody is an antibody that competitively inhibits binding of ErbB2 by pertuzumab. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention. Accordingly, in one embodiment the antibody in the MRD-containing antibody is trastuzumab and 1, 2, 3, 4, 5, 6, or more MRDs in the MRD-containing antibody competitively inhibit binding of ErbB2 by pertuzumab.

In another embodiment, the antibody in the MRD-containing antibody is an ErbB2-binding antibody selected from the group: MDX-210 (Medarex), tgDCC-E1A (Targeted Genetics), MGAH22 (MacroGenics), and pertuzumab (OMNITARG™, 2C4; Genentech). An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, or 4 of the above antibodies are also encompassed by the invention. Thus, the invention encompasses MRD-containing antibodies comprising at least 1, 2, 3, 4, 5, 6, or more MRDs that compete for target binding with at least 1, 2, 3 or 4 of the above antibodies.

In specific embodiments, the MRD containing antibody binds ErbB2 and additionally binds ErbB3. In some embodiments, the antibody component of the MRD-containing antibody binds ErbB2 and an MRD of the MRD-containing antibody binds ErbB3. In a particular embodiment, the antibody component of the MRD-containing antibody is trastuzumab. In additional embodiments, the antibody component, MRD component and/or MRD-containing antibody competes for ErbB2-binding with trastuzumab. In another embodiment, the antibody in the MRD-containing antibody is an ErbB2-binding antibody selected from: MDX-210 (Medarex), tgDCC-E1A (Targeted Genetics), MGAH22 (MacroGenics), and pertuzumab (OMNITARG™). In additional embodiments, the antibody component, MRD component and/or MRD-containing antibody competes for ErbB2-binding with an antibody selected from: MDX-210, tgDCC-E1A, MGAH22, and pertuzumab. In other embodiments, the antibody component of the MRD-containing antibody binds ErbB3 and an MRD of the MRD-containing antibody binds ErbB2.

In some embodiments, the antibody in the MRD-containing antibody comprises the CDRs of the anti-ErbB2 antibody trastuzumab. The CDR, VH, and VL sequences of trastuzumab are provided in Table 1.

TABLE 1

| CDR | Sequence |
|---|---|
| VL-CDR1 | RAS<u>QDVNTA</u>VAW (SEQ ID NO: 59) |
| VL-CDR2 | SA<u>S</u>FLYS (SEQ ID NO: 60) |
| VL-CDR3 | QQ<u>HYTTPPT</u> (SEQ ID NO: 61) |
| VH-CDR1 | G<u>RNIKDTY</u>IH (SEQ ID NO: 62) |

TABLE 1-continued

| CDR | Sequence |
|---|---|
| VH-CDR2 | RIYPTNGYTRYADSVKG (SEQ ID NO: 63) |
| VH-CDR3 | WGGDGFYAMDY (SEQ ID NO: 64) |
| VL | DIQMTQSPSSLSASVGDRVTITCRASQDVNTAVAWYQQKPGK APKLLIYSASFLYSGVPSRFSGSRSGTDFTLTISSLQPEDF ATYYCQQHYTTPPTFGQGTKVEIKRT (SEQ ID NO: 65) |
| VH | EVQLVESGGGLVQPGGSLRLSCAASGFNIKDTYIHWVRQAPG KGLEWVARTYPTNGYTRYADSVKGRFTISADTSKNTAYLQMN SLRAEDTAVYYCSRWGGDGFYAMDYWGQGTLVTVSS (SEQ ID NO: 66) |

In one embodiment the MRD-containing antibody specifically binds ErbB3 (Her3). In a specific embodiment, the antibody is MM121 (Merrimack Pharmaceuticals) or AMG888 (Amgen). In one embodiment, the antibody binds to the same epitope as MM121 or AMG888. In another embodiment, the antibody competitively inhibits binding of MM121 or AMG888 to ErbB3. In another specific embodiment, the antibody is AV-203 (AVEO). In one embodiment, the antibody binds to the same epitope as AV-203. In another embodiment, the antibody competitively inhibits binding of AV-203. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1 or both of the above antibodies are also encompassed by the invention In one embodiment the MRD-containing antibody specifically binds VEGF (VEGFA). In a specific embodiment, the antibody is bevacizumab (e.g., AVASTIN®, Genentech/Roche). In one embodiment, the antibody binds to the same epitope as bevacizumab. In another embodiment, the antibody competitively inhibits binding of bevacizumab to VEGFA. In another embodiment the MRD-containing antibody is AT001 (Affitech). In one embodiment, the antibody binds to the same epitope as AT001. In another embodiment, the antibody competitively inhibits binding of AT001 to VEGFA. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1 or both of the above antibodies are also encompassed by the invention.

In some embodiments, the antibody in the MRD-containing antibody comprises the CDRs of the anti-VEGF antibody bevacizumab. The CDR, VH, and VL sequences of bevacizumab are provided in Table 2.

TABLE 2

| CDR | Sequence |
|---|---|
| VL-CDR1 | SASQDISNYLN (SEQ ID NO: 72) |
| VL-CDR2 | FTSSLHS (SEQ ID NO: 73) |
| VL-CDR3 | QQYSTVPWT (SEQ ID NO: 74) |
| VH-CDR1 | GYTFTNYGMN (SEQ ID NO: 75) |
| VH-CDR2 | WINTYTGEPTYAADFKR (SEQ ID NO: 76) |
| VH-CDR3 | YPHYYGSSHWYFDV (SEQ ID NO: 77) |

TABLE 2-continued

| CDR | Sequence |
|---|---|
| VL | DIQMTQSPSSLSASVGDRVTITCSASQDISNYLNWYQQKPGK APKVLIYFTSSLHSGVPSRFSGSGSGTDFTLTISSLQPEDFA TYYCQQYSTVPWTFGQGTKVEIKR (SEQ ID NO: 78) |
| VH | EVQLVESGGGLVQPGGSLRLSCAASGYTFTNYGMNWVRQAPG KGLEWVGWINTYTGEPTYAADFKRRFTFSLDTSKSTAYLQMN SLRAEDTAVYYCAKYPHYYGSSHWYFDVWGQGTLVTVSS (SEQ ID NO: 79) |

In other specific embodiments, the antibody in the MRD-containing antibody specifically binds VEGF. In a specific embodiment, the antibody is bevacizumab (e.g., AVASTIN®, Genentech). In one embodiment, the antibody binds to the same epitope as bevacizumab. In another embodiment, the antibody competitively inhibits binding of bevacizumab to VEGF. In another specific embodiment, the antibody is r84 (Peregrine) or 2C3 (Peregrine). In another embodiment, the antibody binds to the same epitope as r84 or 2C3. In another embodiment, the antibody competitively inhibits VEGF binding by r84 or 2C3. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, or 3 of the above antibodies are also encompassed by the invention.

In one embodiment, an MRD-containing antibody binds VEGF and additionally binds an angiogenic target selected from: VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, EFNa1, EFNa2, ANG1, ANG2, IL6, IL8, IL18, HGF, TIE2, PDGFA, PLGF, PDGFB, CXCL12, KIT, GCSF, CXCR4, PTPRC, TIE2, VEGFR1, VEGFR2, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind VEGF and at least 1, 2, 3, 4, 5 or more of these targets are also encompassed by the invention. In specific embodiments, the antibody component of the MRD-containing antibody binds VEGF. In further embodiments, the antibody component of the MRD-containing antibody is r85, 2C3 or AT001. In a specific embodiment, the antibody component of the MRD-containing antibody is bevacizumab.

In one embodiment, an MRD-containing antibody binds VEGF and additionally binds a target selected from: IL1 beta, phosphatidylserine, TNFSF11 (RANKL), TNFSF12 (TWEAK), IGF1,2, IGF2, IGF1, DKK1, SDF2, CXC3CL1 (fractalkine), sclerostin and tetanus toxoid and HGF. In another embodiment, an MRD-containing antibody binds VEGF and additionally binds a target selected from: ErbB3, EGFR, cMet, VEGF, RON (MST1R), DLL4, CDCP1 CD318), NRP1, ROBO4, CD13, CTLA4 (CD152), ICOS (CD278), CD20, CD22, CD30, CD33, CD80 and IL6R. Multivalent and multispecific compositions (e.g., MRD-containing antibodies) that bind VEGF and at least 1, 2, 3, 4, 5 or more of these targets are also encompassed by the invention. In specific embodiments, the antibody component of the MRD-containing antibody binds VEGF. In further embodiments, the antibody component of the MRD-containing antibody is r85, 2C3 or AT001. In a specific embodiment, the antibody component of the MRD-containing antibody is bevacizumab.

In another embodiment, the MRD-containing antibody specifically binds VEGFR1. In one embodiment, the antibody competitively inhibits binding of Aflibercept (Regeneron) to VEGFR1. In another embodiment, the antibody in the MRD-containing antibody inhibits VEGFR1 dimerization. An MRD that competes for target binding with Aflibercept is also encompassed by the invention. Multivalent and multispecific compositions (e.g., MRD-containing antibodies) having 1, 2, 3, 4, 5, 6, or more MRDs that compete for target binding with Aflibercept are also encompassed by the invention.

In another embodiment, the MRD-containing antibody specifically binds VEGFR2. In a specific embodiment, the antibody is ramucirumab (e.g., IMC1121B and IMC1C11, ImClone). In another embodiment, the antibody in the MRD-containing antibody inhibits VEGFR2 dimerization. In one embodiment, the antibody binds to the same epitope as ramucirumab. In another embodiment, the antibody competitively inhibits binding of ramucirumab to VEGFR2. In another embodiment, the antibody competitively inhibits binding of Aflibercept to VEGFR2. An MRD that competes for target binding with ramucirumab is also encompassed by the invention. Multivalent and multispecific compositions (e.g., MRD-containing antibodies) having 1, 2, 3, 4, 5, 6, or more MRDs that compete for target binding with ramucirumab or Aflibercept are also encompassed by the invention.

In other embodiments, the antibody in the MRD-containing antibody specifically binds to an FGF receptor (e.g., FGFR1, FGFR2, FGFR3, or FGFR4). In one embodiment, the antibody in the MRD-containing antibody is an antibody that specifically binds to FGFR1 (e.g., FGFR1-IIIC). In a specific embodiment, the antibody is IMC-A1 (Imclone). In one embodiment, the antibody binds to the same epitope as IMC-A1. In another embodiment, the antibody competitively inhibits binding of IMC-A1 to FGFR1. In an additional embodiment, the antibody competitively inhibits binding of FP-1039 (Five Prime) to an FGF ligand of FGFR1. In another embodiment, the antibody in the MRD-containing antibody is an antibody that specifically binds to FGFR2 (e.g., FGFR2-IIIB and FGFR2-IIIC). In a further embodiment, the antibody in the MRD-containing antibody is an antibody that specifically binds to FGFR3. In a specific embodiment, the antibody is IMC-A1 (Imclone). In one embodiment, the antibody binds to the same epitope as PRO-001 (ProChon Biotech), R3Mab (Genentech), or 1A6 (Genentech). In another embodiment, the antibody competitively inhibits binding of PRO-001 (ProChon Biotech), R3Mab (Genentech), or 1A6 (Genentech). An MRD that competes for target binding with one of the above antibodies or ligand traps is also encompassed by the invention. Multivalent and multispecific compositions (e.g., MRD-containing antibodies) having 1, 2, 3, 4, 5, 6, or more MRDs that compete for target binding with 1 or more of the above antibodies or ligand traps are also encompassed by the invention.

In one embodiment, the antibody in the MRD-containing antibody specifically binds CD20. In a specific embodiment the antibody is rituximab (e.g., RITUXAN®/MAB-THERA®, Genentech/Roche/Biogen Idec). In one embodiment, the antibody binds to the same epitope as rituximab. In another embodiment, the antibody competitively inhibits binding of rituximab to CD20. In an additional embodiment, the antibody is GA101 (Biogen Idec/Roche/Glycart). In one embodiment, the antibody binds to the same epitope as GA101. In another embodiment, the antibody competitively inhibits binding of GA101 to CD20. In an additional embodiment, the antibody is PF-5,230,895 (SBI-087; Pfizer). In one embodiment, the antibody binds to the same epitope as PF-5,230,895. In another embodiment, the antibody competitively inhibits binding of PF-5,230,895 to CD20. In another specific embodiment, the antibody is ocrelizumab (e.g., 2H7; Genentech/Roche/Biogen Idec). In one embodiment, the antibody binds to the same epitope as ocrelizumab. In another embodiment, the antibody competitively inhibits binding of ocrelizumab to CD20. In another specific embodiment, the MRD-containing antibody is selected from: obinutuzumab (e.g., GA101; Biogen Idec/Roche/Glycart), ofatumumab (e.g., ARZERRA® and HuMax-CD20 Genmab), veltuzumab (e.g., IMMU-160, Immunomedics), AME-133 (Applied Molecular Evolution), SGN35 (Millennium), TG-20 (GTC Biotherapeutics), afutuzumab (Hoffman-La Roche) and PRO131921 (Genentech). In another embodiment, the antibody binds to the same epitope as an antibody selected from: obinutuzumab, ofatumumab, veltuzumab, AME-133, SGN35, TG-20 and PRO131921. In another embodiment, the antibody competitively inhibits CD20 binding by an antibody selected from: obinutuzumab, ofatumumab, veltuzumab, AME-133, SGN35, TG-20, afutuzumab, and PRO131921. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention. Thus, the invention encompasses MRD-containing antibodies comprising at least 1, 2, 3, 4, 5, 6, or more MRDs that compete for target binding with at least 1, 2, 3, 4, 5, 6 of the above antibodies.

In additional embodiments, an MRD-containing antibody binds CD20 and a target selected from: CD19, CD22, CD30, TNFRSF5 (CD40), CD52, CD74, CD80, CD138, VEGFR1, VEGFR2, EGFR, TNFRSF10A (DR4), TNFRSF10B (DR5), TNF, NGF, VEGF, IGF1,2, IGF2, IGF1 and RANKL. In additional embodiments, an MRD-containing antibody binds CD20 and a target selected from: CD3, CD4 and NKG2D. Multivalent and multispecific compositions (e.g., MRD-containing antibodies) that bind CD20 and also bind 2, 3, 4, 5 or more of these targets are also encompassed by the invention. In specific embodiments, the antibody component of the MRD-containing antibody binds CD20. In further embodiments, the antibody component of the MRD-containing antibody is an antibody selected from: rituximab, GA101, PF-5,230,895, ocrelizumab obinutuzumab, ofatumumab, veltuzumab, AME-133, SGN35, TG-20, afutuzumab and PRO131921.

In one embodiment the MRD-containing antibody specifically binds IGF1R. In a specific embodiment, the antibody is selected from: cixutumumab (e.g., IMC-A12, Imclone), figitumumab (e.g., CP-751,871, Pfizer), AMG479 (ganitumab, Amgen/Millennium), BIIB022 (Biogen Idec), SCH 717454 (Schering-Plough), and R1507 (Hoffman La-Roche). In one embodiment, the antibody binds to the same epitope as an antibody selected from: cixutumumab, figitumumab, AMG479, BIIB022, SCH 717454, and R1507. In another embodiment, the antibody competitively inhibits IGF1R binding by an antibody selected from: cixutumumab, figitumumab, AMG479, BIIB022, SCH 717454, and R1507. In a specific embodiment, the antibody is figitumumab. In another specific embodiment, the antibody binds to the same epitope as figitumumab. In a further specific embodiment, the antibody competitively inhibits IGF1R binding by figitumumab. In an additional specific embodiment, the antibody is BI1B022. In another specific embodiment, the antibody binds to the same epitope as BIIB022. In a further specific embodiment, the antibody competitively inhibits IGF1R binding by BIIB022. In another embodiment, the antibody in the MRD-containing antibody inhibits IGF1R dimerization. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for IGF1R binding with 1, 2, 3, 4, 5, 6, or more of the above antibodies are also encompassed by the invention. Thus, the invention encompasses MRD-containing antibodies comprising at least 1, 2, 3, 4, 5, 6, or more MRDs that compete for IGF1R binding with at least 1, 2, 3, 4, 5, 6 of the above antibodies.

In additional embodiments, an MRD-containing antibody binds IGF1R and a target selected from: EGFR, ErbB2, ErbB3, PDGFRa, PDGFRb, cMet, TNFRSF10A (DR4), TNFRSF10B (DR5), CD20, NKG2D, VEGF, PGE2, IGF1, IGF2 and IGF1,2. In additional embodiments, an MRD-containing antibody binds IGF1R and a target selected from: CD3, CD4 and NKG2D. Multivalent and multispecific compositions (e.g., MRD-containing antibodies) that bind IGF1R and bind at 1, 2, 3, 4, 5 or more of these targets are also encompassed by the invention. In specific embodiments, the antibody component of the MRD-containing antibody binds IGF1R. In further embodiments, the antibody component of the MRD-containing antibody is selected from: cixutumumab, figitumumab, AMG479, BIIB022, SCH 717454, and R1507.

In additional embodiments, the multivalent and monovalent multispecific composition (e.g., MRD-containing antibody) binds a target (e.g., ligand, receptor, or accessory protein) associated with an endogenous blood brain barrier (BBB) receptor mediated transport system (e.g., the insulin receptor, transferrin receptor, leptin receptor, lipoprotein receptor, and the IGF receptor mediated transport systems) and is capable of crossing to the brain side of the BBB. In some embodiments, the multivalent and monovalent multispecific composition (e.g., MRD-containing antibody) has 2, 3, 4, 5, or more binding sites (i.e., is capable of multivalently binding) a target antigen (e.g., ligand, receptor, or accessory protein) associated with an endogenous BBB receptor mediated transport system (e.g., the insulin receptor, transferrin receptor, leptin receptor, lipoprotein receptor, and the IGF receptor mediated transport systems). In additional embodiments, the multivalent and monovalent multispecific composition (e.g., MRD-containing antibody) has a single binding site for a target associated with an endogenous BBB receptor mediated transport system. In further embodiments, the multivalent and monovalent multispecific composition has 2, 3, 4, 5, or more single binding sites for a target associated with an endogenous BBB receptor mediated transport system. In further embodiments, the MRD-containing antibody binds 1, 2, 3, 4, 5, or more targets located on the brain (cerebrospinal fluid) side of the BBB. In further embodiments, the MRD-containing antibody additionally binds 1, 2, 3, 4, 5, or more targets located on the brain (cerebrospinal fluid) side of the BBB. In particular embodiments, the MRD-containing antibody binds 1, 2, 3, 4, 5, or more targets associated with a neurological disease or disorder. In particular embodiments, the neurological disease or disorder is selected from brain cancer, a neurodegenerative disease, schizophrenia, epilepsy, Alzheimer's disease, Parkinson's disease, Huntington's disease, ALS, multiple sclerosis, Neuromyelitis optica and Neuro-AIDS (e.g., HIV-associated dementia). Accordingly, the invention encompasses methods of treating a patient by administering a therapeutically effective amount of a multivalent and monovalent multispecific composition to treat a neurological disease or disorder selected from brain cancer, a neurodegenerative disease, schizophrenia, epilepsy, Alzheimer's disease, Parkinson's disease, Huntington's disease, ALS, multiple sclerosis, Neuromyelitis optica and Neuro-AIDS (e.g., HIV-associated dementia). In another embodiment, the multivalent and monovalent multispecific composition is administered to a patient to treat a brain cancer, metastatic cancer of the brain, or primary cancer of the brain. In additional embodiments, the multivalent and monovalent multispecific composition is administered to a patient to treat a neurological tumor such as, a glioma (e.g., a glioblastoma, glioblastoma multiforme (GBM), and astrocytoma), ependymoma, oligodendroglioma, neurofibroma, sarcoma, medulloblastoma, primitive neuroectodermal tumor, pituitary adenoma, neuroblastoma or cancer of the meninges (e.g., meningioma, meningiosarcoma and gliomatosis). In particular embodiments the invention encompasses methods of treating a patient by administering a therapeutically effective amount of a multivalent and monovalent multispecific composition to treat a neurodegenerative disease.

In some embodiments, the multivalent and monovalent multispecific composition (e.g., MRD-containing antibody) binds an endogenous BBB receptor mediated transport system selected from the insulin receptor, transferrin receptor, leptin receptor, lipoprotein receptor, and the IGF receptor mediated transport systems.

In some embodiments, the multivalent and multispecific composition (e.g., MRD-containing antibody) binds transferrin receptor. In additional embodiments, the MRD-containing antibody binds a target selected from: low-density lipoprotein receptor 1 (LRP-1), a LRP-1 ligand or a functional fragment or variant thereof that binds LRP-1, Low-density lipoprotein receptor 2 (LRP-2), a LRP-2 ligand or a functional fragment or variant thereof that binds LRP-1, a transferrin protein or a functional fragment or variant thereof, insulin receptor, TMEM30A, leptin receptor, IGF receptor, an IGFR ligand or a functional fragment or variant thereof, diphtheria receptor, a diphtheria receptor ligand or a functional fragment or variant thereof, choline transporter, a complex that binds choline receptor, an amino acid transporter (e.g., LAT1/CD98, SLC3A2, and SLC7A5), an amino acid transporter ligand or a functional fragment or variant thereof, RAGE, a RAGE ligand or a functional fragment or variant thereof, SLC2A1 and a SLC2A1 ligand or a functional fragment or variant thereof.

In additional embodiments, the multivalent and multispecific composition (e.g., MRD-containing antibody) binds RAGE. In further embodiments, the multivalent and multispecific composition (e.g., MRD-containing antibody) binds RAGE and a target selected from: Abeta, endothelin1, TNF, IL6, MCSF, an AGE, a S100 member, HMGB1, LPS and TLR2. Multivalent and multispecific compositions that bind RAGE and also bind 2, 3, 4, 5 or more of these targets are also encompassed by the invention. In specific embodiments, the antibody component of the MRD-containing antibody binds RAGE.

In additional embodiments, the multivalent and multispecific composition (e.g., MRD-containing antibody) binds a target antigen associated with an endogenous blood brain barrier (BBB) receptor mediated transport system and also binds a target antigen selected from alpha-synuclein, RGM A, NOGO A, NgR, OMGp MAG, CSPG, neurite inhibiting semaphorins (e.g., Semaphorin 3A and Semaphorin 4) an ephrin, A-beta, AGE (S100 A, amphoterin), NGF, soluble A-B, aggrecan, midkine, neurocan, versican, phosphacan, Te38, and PGE2, IL1, IL1R, IL6, IL6R, IL12, IL18, IL23, TNFSF12 (TWEAK), TNFRSF5 (CD40), TNFSF5 (CD40 LIGAND), CD45RB, CD52, CD200, VEGF, VLA4, TNF alpha, Interferon gamma, GMCSF, FGF, C5, CXCL13, CCR2, CB2, MIP 1a and MCP-1. In a further embodiment, the MRD-containing antibody has a single binding site for a target associated with an endogenous blood brain barrier (BBB) receptor mediated transport system and further binds a target selected from alpha-synuclein, RGM A, NOGO A, NgR, OMGp MAG, CSPG, neurite inhibiting semaphorins (e.g., Semaphorin 3A and Semaphorin 4) an ephrin, A-beta, AGE (S100 A, amphoterin), NGF, soluble A-B, aggrecan, midkine, neurocan, versican, phosphacan, Te38, PGE2, IL1R, IL6, IL6R, IL12, IL18, IL23, TNFSF12 (TWEAK), TNFRSF5 (CD40), TNFSF5 (CD40 LIGAND), CD45RB, CD52, CD200, VEGF, VLA4, TNF alpha, Interferon gamma, GMCSF, FGF, C5, CXCL13, CCR2, CB2, MIP 1a and MCP-1.

In additional embodiments, the MRD-containing antibody is administered to a patient to treat a neurological disease or disorder selected from brain cancer, a neurodegenerative disease, schizophrenia, epilepsy, Alzheimer's disease, Parkinson's disease, Huntington's disease, ALS, multiple sclerosis, Neuromyelitis optica and Neuro-AIDS (e.g., HIV-associated dementia). In one embodiment, the multivalent and monovalent multispecific composition contains 2 binding sites for 2 or more of the above targets. In a further embodiment, the multivalent and monovalent multispecific composition contains 2 binding sites for 3 or more targets. In additional embodiments, the targets bound by the multivalent and monovalent multispecific composition are associated with cancer. In a further embodiment the targets bound by the multivalent and monovalent multispecific composition are associated with 1, 2, 3, 4, 5 or more different signaling pathways or modes of action associated with cancer.

In one embodiment, the antibody in the MRD-containing antibody specifically binds integrin. In a specific embodiment, the antibody is selected from: MEDI-522 avb3 (VITAXIN®, MedImmune), CNTO 95 a5b3 (Centocor), JC7U αvβ3, and voloximab a5b1 (e.g., M200, PDL and Biogen Idec). In another embodiment, the antibody binds to the same epitope as an antibody selected from: MEDI-522, CNTO 95, JC7U αvβ3, and voloximab. In another embodiment, the antibody competitively inhibits integrin binding by an antibody selected from: MEDI-522, CNTO 95, JC7U, and M200. In a specific embodiment, the antibody is natalizumab (e.g., TSABRI®, Biogen Idec). In one embodiment, the antibody binds to the same epitope as natalizumab. In another embodiment, the antibody competitively inhibits integrin binding by natalizumab. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention.

In one embodiment, the antibody in the MRD-containing antibody specifically binds cMet. In a specific embodiment, the antibody is selected from: MetMab (OA-5D5, Genentech), AMG-102 (Amgen) and DN30. In another embodiment, the antibody binds to the same epitope as an antibody selected from: MetMab), AMG-102 and DN30. In another embodiment, the antibody competitively inhibits cMET binding by an antibody selected from: MetMab (OA-5D5), AMG-102 and DN30. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, or 3 of the above antibodies are also encompassed by the invention.

In one embodiment, the antibody in the MRD-containing antibody specifically binds cMet and the antibody is selected from: 11E1, CE-355621, LA480 and LMH87. In another embodiment, the antibody binds to the same epitope as an antibody selected from: MetMab), AMG-102 and DN30. In another embodiment, the antibody competitively inhibits cMET binding by an antibody selected from: 11E1, CE-355621, LA480 and LMH87. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3 or 4 of the above antibodies are also encompassed by the invention.

In additional embodiments, an MRD-containing antibody binds cMET and a target selected from: ErbB2, ErbB3, EGFR, IGF1R, NRP1, RON, PDGFRa, PDGFRb, VEGF, VEGFR1, VEGFR2, TGF beta, TGF beta R2, CD82, CD152, NGF, BMP2, BMP4, BMP5, BMP9, BMP10, BMPR-IA, ALK1, a3b1 integrin and HGF. Multivalent and multispecific compositions (e.g., MRD-containing antibodies) that bind cMET and also bind at least 1, 2, 3, 4, 5 or more of these targets are also encompassed by the invention. In specific embodiments, the antibody component of the MRD-containing antibody binds cMET. In further embodiments, the antibody component of the MRD-containing antibody is an antibody selected from: MetMab, AMG-102 and DN30. In other embodiments, the antibody component of the MRD-containing antibody is an antibody selected from: 11E1, CE-355621, LA480 and LMH87.

In additional embodiments, an MRD-containing antibody binds MST1R (RON). In a specific embodiment, an MRD-containing antibody binds RON and a target selected from: EGFR, ErbB2, ErbB3, VEGFR1, VEGFR2, cMET, CXCR4, VEGF, MST, MTSP1, CDCP1, EPHB2, NGF, CXCL12 and HGF (SF). Multivalent and multispecific compositions (e.g., MRD-containing antibodies) that bind MST1R and also bind at least 1, 2, 3, 4, 5 or more of these targets are also encompassed by the invention. In specific embodiments, the antibody component of the MRD-containing antibody binds MST1R.

In one embodiment, the antibody in the MRD-containing antibody specifically binds HGF (SF). In a specific embodiment, the antibody is AMG-102 (Amgen) or SCH 900105 (AV-229, AVEO). In another embodiment, the antibody binds to the same epitope as AMG-102 (Amgen) or SCH 900105 (AV-229, AVEO). In another embodiment, the antibody competitively inhibits HGF binding by AMG-102 (Amgen) or SCH 900105 (AV-229, AVEO). An MRD that competes for target binding with AMG-102 (Amgen) or SCH 900105 (AV-229, AVEO) is also encompassed by the invention. Multivalent and multispecific compositions (e.g., MRD-containing antibodies) having 1, 2, 3, 4, 5, 6, or more MRDs that compete for target binding with 1, 2, or 3 of the above antibodies are also encompassed by the invention.

In a specific embodiment, an MRD-containing antibody binds HGF and a target selected from: ErbB2, ErbB3, EGFR, IGF1R, NRP1, RON, PDGFRa, PDGFRb, VEGF, VEGFR1, VEGFR2, TGF beta, TGF beta R2, CD82, CD152, NGF, BMP2, BMP4, BMP5, BMP9, BMP10, BMPR-IA, ALK1, a3b1 integrin, cMET, MST1R (RON), CXCR4, MST, MTSP1, CDCP1, EPHB2, NGF, CXCL12 NRP1 and phosphatidylserine. Multivalent and multispecific compositions (e.g., MRD-containing antibodies) that bind HGF and also bind at least 1, 2, 3, 4, 5 or more of these targets are also encompassed by the invention. In specific embodiments, the antibody component of the MRD-containing antibody binds HGF. In further embodiments, the antibody component of the MRD-containing antibody is AMG-102 or SCH 900105.

In an additional embodiment, the antibody in the MRD-containing antibody specifically binds a5b1 integrin (VLA5). In a specific embodiment, the antibody is volociximab (e.g., M200 Biogen Idec). In another embodiment, the antibody binds to the same epitope as volociximab. In a further embodiment, the antibody competitively inhibits a5b1 integrin binding by volociximab. An MRD that competes for a5b1 integrin binding with volociximab is also encompassed by the invention. Multivalent and multispecific compositions (e.g., MRD-containing antibodies) having 1, 2, 3, 4, 5, 6, or more MRDs that compete for a5b1 integrin binding with volociximab are also encompassed by the invention.

In another embodiment, the antibody target of the MRD-containing antibody is an antigen associated with an autoimmune disorder, inflammatory or other disorder of the immune system or is associated with regulating an immune response.

In another embodiment the MRD-containing antibody improves the performance of antigen presenting cells (e.g., dendritic cells). In one embodiment the antibody target of the MRD-containing antibody is a member selecting from: CD19, CD20, CD21, CD22, CD23, CD27, CD28, CD30, CD30L, TNFSF14 (LIGHT, HVEM Ligand), CD70, ICOS, ICOSL (B7-H2), CTLA4, PD-1, PDL1 (B7-H1), B7-H4, B7-H3, PDL2 (B7-DC), BTLA, CD46, CD80 (B7-1), CD86 (B7-2), HLA-DR, CD74, PD1, TNFRSF4 (OX40), TNFRSF9 (41BB), TNFSF4 (OX40 Ligand), TNFSF9 (41BB Ligand), TNFRSF1A (TNFR1, p55, p60), TNFRSF1B (TNFR2), TNFRSF13B (TACI), TNFRSF13C (BAFFR), TNFRSF17 (BCMA), TNFRSF18 (GITR), MHC-1, TNFRSF5 (CD40), TLR4, TNFRSF14 (HVEM), FcgammaRIIB, and IL4R.

In one embodiment the antibody target of the MRD-containing antibody is an immunoinhibitory target selected from: IL1, IL1 beta, IL1Ra, L-5, IL6, IL6R, CD26L, CD28, CD80, FcRn, and Fc Gamma RIIB. An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention.

In one embodiment, an MRD-containing antibody binds prostaglandin E2 (PGE2). In a specific embodiment, an MRD-containing antibody binds IL6R and a target selected from: EGFR, IGF1R, IL6R, TNF, NGF, IL1 beta, IL6, IL17A, VEGF, IL15, IL18, S1P and Abeta. Multivalent and multispecific compositions (e.g., MRD-containing antibodies) that bind PGE2 and also bind at least 1, 2, 3, 4, 5 or more of these targets are also encompassed by the invention. In specific embodiments, the antibody component of the MRD-containing antibody binds PGE2.

In an additional embodiment, the MRD-containing antibody modulates immune responses, immune cell homeostasis, or maintenance of immune tolerance through multispecific and multi-valent binding of soluble, cell surface or extra-cellular matrix associated molecules.

In one embodiment, the MRD-containing antibody binds one or more cytokines or chemokines that modulate immune responses, immune cell homeostasis, or maintenance of immune tolerance. In a further embodiment, the MRD-containing antibody binds one or more cytokines or chemokines selected from: IL1, IL2, IL6, IL7, IL9, IL10, IL12, IL15, IL17, IL18, IL23, IL35, IFNgamma, IFNalpha, IFNbeta, CCL17, CCL21, CCL22, CXCL9, CXCL10, CXCL11, TGFbeta, LIGHT, and TL1a. In one embodiment, the MRD-containing antibody binds a chemokine that modulates immune responses through immune cell migration. In a further embodiment, the MRD-containing antibody binds a chemokine selected from CCL17, CCL22 and CCL21. In another embodiment, the MRD-containing antibody binds a combination of soluble factors that modulate the activity of T lymphocytes. In a further embodiment, the MRD-containing antibody binds a combination of soluble factors selected from: IL2 and IFNgamma; IL2 and IFNalpha; IL2 and TGFbeta1; IFNgamma and TGFbeta1; and IFNalpha and TGFbeta1. In an additional embodiment, the MRD-containing antibody binds a soluble factor that modulates CD25 expression or the intracellular expression of FOXP3 in T lymphocytes. In some embodiments, the MRD-containing antibody binds two, three, four, five or six cytokines or chemokines that modulate immune responses, immune cell homeostasis, or maintenance of immune tolerance factors.

In an additional embodiment, the MRD-containing antibody binds one or more cell surface associated molecules that modulate immune responses, immune cell homeostasis, or maintenance of immune tolerance. In a further embodiment, the MRD-containing antibody binds one or more cell surface associated molecules selected from: PDL1, PDL2, PD1, CD80, CD86, CTLA4, B7-H2, ICOS, B7-H3, B7-H4, HVEM, BTLA, MHC class1, MHC class II, KIR, TCRalpha, TCRbeta, TCRgamma, LAG3, CD137, C137L, OX40, OX40L, CD70, CD27, CD40, CD40L, GAL9, TIM3, TLR1, TLR2, TLR3, TLR4, TLR5, TLR6, TLR7, TLR8, TLR9, TLR10 and A2aR. In one embodiment, the MRD-containing antibody binds one or more cell surface molecules that influence immune cell migration. In a further embodiment, the MRD-containing antibody binds a molecule selected from CCR4, CCR7, and CXCR3. In another embodiment, the MRD-containing antibody binds a combination of cell surface molecules that modulate T lymphocyte function including. In a further embodiment, the MRD-containing antibody binds a combination of soluble factors selected from: CD25 and CTLA4; PD1 and CTLA4; B7-H3 and B7-H3R; B7-H4 and B7H4R; BTLA and HVEM; KIR and LAG3; A2aR and TIM3; TIM3 and CTLA4; PDL1 and PD1; PDL2 and PD1; and CD80 and CD86. In another embodiment, the MRD-containing antibody antagonizes two or more of the inhibitory signals delivered to T lymphocytes through inhibitory receptors. In a further embodiment, the MRD-containing antibody antagonizes two or more inhibitory signals delivered to T lymphocytes including a signal delivered through an inhibitory receptor selected from: PD1, CTLA4, BTLA, HVEM, KIR, LAG3, TIM3, and A2aR. In another embodiment, the MRD-containing antibody enhances the co-stimulatory signals delivered to T lymphocytes through one or more of the co-stimulatory receptors. In a further embodiment, the MRD-containing antibody enhances two or more co-stimulatory signals delivered to T lymphocytes including a signal delivered through a co-stimulatory receptor selected from: CD28, ICOS, OX40 and CD27. In one embodiment, the MRD-containing antibody binds a molecule that modulates CD25 or FOXP3 expression in T lymphocytes. In another embodiment, the MRD-containing antibody binds a molecule that modulates CD39 expression on T lymphocytes. In some embodiments, the MRD-containing antibody binds two, three, four, five or six cell surface associated molecules that modulate immune responses, immune cell homeostasis, or maintenance of immune tolerance.

In an additional embodiment, the MRD-containing antibody binds one or more cell surface molecules expressed on antigen-presenting cells. In a further embodiment, the MRD-containing antibody binds one or more cell surface molecules selected from PDL1, PDL2, CD80, CD86, B7RP1, B7-H3, B7-H4, HVEM, CD137L, OX40, CD70, and GAL3. In one embodiment, the MRD-containing antibody binds a molecule on antigen-presenting cells that modulates CD25 or FOXP3 expression in human T lymphocytes. In another embodiment, the MRD-containing antibody binds a combination of molecules on the surface of an accessory cell. In a further embodiment, the MRD-containing antibody binds a combination of molecules selected from: CD80 and CD86; B7-H3 and B7-H4; PDL1 and PDL2; HVEM and B7-H2; CD137L and HVEM; GAL9 and OX40L; HVEM, PDL1 and PDL2; CD80, CD86 and HVEM; and B7-H3, B7-H4 and B7-H2. The MRD-containing antibody may bind one, two, three, four, five six, seven, eight or more cell surface molecules expressed on antigen-presenting cells.

In another embodiment, the MRD-containing antibody binds one or more cell-surface molecules on the surface of antigen-presenting cells and one or more cell surface molecules expressed on the surface of T lymphocytes. The MRD-containing antibody may bind a combination of one, two, three, or four cell surface molecules expressed on the surface of human antigen-presenting cells and one, two, three, or four cell surface molecules expressed on the surface of human T lymphocytes. In a preferred embodiment, the combination of molecules bound by the MRD-containing antibody share co-stimulatory or inhibitory effects on T lymphocytes. In another preferred embodiment, the combination of molecules bound by the MRD-containing antibody, stabilize cell-cell contact between immune cells.

In an additional embodiment, the MRD-containing antibody antagonizes regulatory T lymphocyte (Treg) function through antagonism of soluble molecules and/or cell surface receptors. In one embodiment, the MRD-containing antibody binds one or more soluble molecules and/or one or more cell surface receptors that coordinately enhance Treg function. In one embodiment, the MRD-containing antibody binds Treg cells and inhibits their function. In another embodiment, the MRD-containing antibody binds Treg cells and enhances their function. In a further embodiment, the MRD-containing antibody binds one or more molecules selected from: PDL1, PDL2, PD1, CD80, CD86, CTLA4, B7-H2, ICOS, B7-H3, B7-H4, HVEM, BTLA, MHC class1, MHC class II, KIR, TCRalpha, TCRbeta, TCRgamma, LAG3, CD137, C137L, OX40, OX40L, CD70, CD27, CD40, CD40L, GAL9, TIM3, TLR1, TLR2, TLR3, TLR4, TLR5, TLR6, TLR7, TLR8, TLR9, TLR10 and A2aR. In an additional embodiment, the MRD-containing antibody binds Treg cells and antagonizes the activity of a soluble factor that acts on Treg cells.

The multivalent and multispecific binding properties of MRD-containing antibodies of the invention allow for the rational design of therapeutics that preferentially direct the in vivo localization of the MRD-containing antibody to specific anatomical sites in which the target of the antibody and/or MRD components of the MRD-containing antibodies is present. In one embodiment, the MRD-containing antibody localizes to a site of inflammation by binding of the antibody combining site to a molecule characterized by increased expression in the site of inflammation. In further embodiments, the antibody combining site binds a molecule selected from: an adhesion molecule, an integrin, madCam, CD44 and CD45. In further embodiments, the MRD-containing antibody further comprises a MRD that binds to a cell surface molecule on a Treg that enhances Treg activity. In a further embodiment, the MRD-containing antibody binds a co-stimulatory receptor selected from: CD28, ICOS, OX40 and CD27. In particular embodiments the binding affinity of the MRD-containing antibody for the target in the site of inflammation in vivo is at least 3×, at least 10×, at least 30× or at least 100× that of the MRD-containing antibody for the Treg cell surface molecule.

In another embodiment, the invention provides for a method of preferentially directing the in vivo localization of an MRD-containing antibody to a tumor site. In some embodiments, the antibody combining site of the MRD-containing antibody binds a tumor-associated antigen and an MRD of the MRD-containing antibody binds a cell surface molecule on a Treg that suppresses Treg function. In a further embodiment, the MRD-containing antibody binds a co-stimulatory receptor selected from: PD1, CTLA4, BTLA, HVEM, KIR, LAG3, TIM3, and A2aR. In another embodiment, the antibody combining site of the MRD-containing antibody binds a tumor-associated antigen and an MRD binds a cell surface molecule on a Treg that suppresses Treg function. In an additional embodiment, the antibody combining site binds a tumor associated antigen and an MRD of the MRD-containing antibody binds a cell surface molecule on effector T lymphocytes that enhances the activity of T effector cells. In a further embodiment, the MRD-containing antibody binds a co-stimulatory receptor selected from: CD28, ICOS, OX40 and CD27. In particular embodiments the binding affinity of the MRD-containing antibody for the tumor associated antigen in vivo is at least 3×, at least 10×, at least 30× or at least 100× that of the MRD-containing antibody for the Treg cell surface molecule.

In a further embodiment, the antibody combining site and/or an MRD of an MRD-containing antibody binds a tumor-associated antigen that delivers an inhibitory signal to a T lymphocyte. In particular embodiments, MRD-containing antibody binds CD80 or CD86. In further embodiments, MRD-containing antibody binds B7H1, B7H3 or B7H4.

In another embodiment the antibody target of the MRD-containing antibody is an immunostimulatory target (e.g., an agonist of a target associated immune cell activation (such as, TNFRSF9 (41 BB) or TNFRSF5 (CD40)) or an antagonist of an inhibitory immune checkpoint (such as CTLA-4)). In one embodiment, the antibody target of the MRD-containing antibody is an immunostimulatory target selected from: CD25, CD28, CTLA-4, PD1, PDL1, B7-H1, B7-H4, IL10, TGFbeta, TNFSF4 (OX40 Ligand), TNFRSF4 (OX40), TNFSF5 (CD40 Ligand), TNFRSF5 (CD40), TNFSF9 (41BB Ligand), TNFRSF9 (41BB), TNFSF14 (LIGHT, HVEM Ligand), TNFRSF14 (HVEM), TNFSF15 (TL1A), TNFRSF25 (DR3), TNFSF18 (GITR Ligand), and TNFRSF18 (GITR). In another embodiment, the antibody target of the MRD-containing antibody is an immunostimulatory target selected from: CD272 (BTLA), TIM3, GALS, B7-DC (PDL2), and PDL2 receptor. An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. In specific embodiments, the MRD-containing antibody binds 2, 3 or all 4 targets selected from CTLA-4, TNFRSF18 (GITR), 4-1BB, and TNFRSF5 (CD40). In one embodiment, the MRD-containing antibody binds CTLA-4 and TNFRSF9 (41BB).

In another embodiment, the MRD-containing antibody binds CTLA-4 and TNFRSF18 (GITR). In another embodiment, the MRD-containing antibody binds CTLA-4 and TNFRSF5 (CD40). In another embodiment, the MRD-containing antibody binds TNFRSF5 (CD40) and TNFRSF9 (41BB). In another embodiment, the MRD-containing antibody binds TNFRSF4 (OX40) and TNFRSF9 (41BB). In another embodiment, the MRD-containing antibody binds PD1 and B7-H1. In an additional embodiment the MRD-containing antibody enhances an immune response, such as the immune system's anti-tumor response or an immune response to a vaccine.

In another embodiment the antibody target of the MRD-containing antibody is a cytokine selected from: IL1 alpha, IL1 beta, IL18, TNFSF2 (TNFa), LTalpha, LT beta, TNFSF11 (RANKL), TNFSF13B (BLYS), TNFSF13 (APRIL), IL6, IL7, IL10, IL12, IL15, IL17A, IL23, OncoStatinM, TGFbeta, BMP2-15, PDGF (e.g., PDGF-A, PDGF-B, PDGF-CC, PDGF-C, PDGF-D), an FGF family member (e.g., FGF1, FGF2, FGF4, FGF7, FGF8b and FGF19), VEGF (e.g., VEGFA and VEGFB), MIF, and a type I interferon. MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. Thus, the invention encompasses MRD-containing antibodies comprising at least 1, 2, 3, 4, 5, 6, or more MRDs that bind to at least 1, 2, 3, 4, 5, 6 of the above targets.

In another embodiment the antibody target of the MRD-containing antibody is a cytokine selected from: TNF, CD25, CD28, CTLA-4, PD1, PDL1, B7-H1, B7-H4, IL10, TGF-beta, TNFSF4 (OX40 Ligand), TNFRSF4 (OX40), TNFSF5 (CD40 Ligand), TNFRSF5 (CD40), TNFSF9 (41BB Ligand), TNFRSF9 (41BB), TNFSF14 (LIGHT, HVEM Ligand), TNFRSF14 (HVEM), TNFSF15 (TL1A), TNFRSF25 (DR3), TNFSF18 (GITR Ligand), and TNFRSF18 (GITR). An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. Thus, the invention encompasses MRD-containing antibodies comprising at least 1, 2, 3, 4, 5, 6, or more MRDs that bind to at least 1, 2, 3, 4, 5, 6 of the above targets.

In one embodiment the antibody target of the MRD-containing antibody is IL1Ra, IL1Rb, IL2, IL3, IL7, IL10, IL11, IL15, IL16, IL17, IL17A, IL17F, IL18, IL19, IL25, IL32, IL33, interferon beta, SCF, BCA1/CXCL13, CXCL1, CXCL2, CXCL6, CXCL13, CXCL16, C3AR, C5AR, CXCR1, CXCR2, CXCR3 CCR1, CCR3, CCR4, CCR7, CCR8, CCR9, CCR10, ChemR23, CCL3, CCL5, CCL11, CCL13, CCL17, CCL18, CCL19, CCL20, CCL21, CCL22, CCL24, CCL25, CCL26, CCL27, MPL, GP130, TLR2, TLR3, TLR4, TLR5, TLR7, TLR8, TLR9, TREM1, TREM2, FcRn, FcGamma RIIB, oncostatin M, lymphotoxin alpha (LTa), integrin beta 7 subunit, CD49a (integrin alpha 1), integrin a5b3, MIF, ESM1, WIF1, cathepsin B, cathepsin D, cathepsin K, cathepsin S, TNFSF2 (TNFa), TNFSF3 (LTb), TNFRSF3 (LTBR), TNFSF6 (Fas Ligand), TNFRSF6 (Fas, CD95), TNFRSF6B (DcR3), TNFSF8 (CD30 Ligand), TNFRSF8 (CD30), TNFSF9 (41BB Ligand), TNFSF11 (RANKL), TNFRSF11A (RANK), TNFSF14 (LIGHT, HVEM Ligand), TNFRSF14 (HVEM), TNFRSF16 (NGFR), TNFSF18 (GITR Ligand), TNFRSF18 (GITR), TNFRSF19L (RELT), TNFRSF19 (TROY), TNFRSF21 (DR6), CD14, CD23 CD25, CD28, CD36, CD36L, CD39, CD52, CD91, CD153, CD164, CD200, CD200R, BTLA, CD80 (B7-1), CD86 (B7-2), B7h, ICOS, ICOSL (B7-H2), MHC, CD, B7-H3, B7H4, B7x, SLAM, KIM-1, SLAMF2, SLAMF3, SLAMF4, SLAMF5, SLAMF6, or SLAMF7. An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. Thus, the invention encompasses MRD-containing antibodies comprising at least 1, 2, 3, 4, 5, 6, or more MRDs that bind to at least 1, 2, 3, 4, 5, 6 of the above targets. The above antibody and MRD targets and those otherwise described herein are intended to be illustrative and not limiting.

In another embodiment, the antibody target of the MRD-containing antibody is TNFSF1A (TNF/TNF-alpha), TNFRSF1A (TNFR1, p55, p60), TNFRSF1B (TNFR2), TNFSF7 (CD27 Ligand, CD70), TNFRSF7 (CD27), TNFSF13B (BLYS), TNFSF13 (APRIL), TNFRSF13B (TACI), TNFRSF13C (BAFFR), TNFRSF17 (BCMA), TNFSF15 (TL1A), TNFRSF25 (DR3), TNFSF12 (TWEAK), TNFRSF12 (TWEAKR), TNFSF4 (OX40 Ligand), TNFRSF4 (OX40), TNFSF5 (CD40 Ligand), TNFRSF5 (CD40), IL1 beta, IL1R, IL2R, IL4-Ra, IL5, IL5R, IL6, IL6R, IL9, IL12, IL13, IL14, IL15, IL15R, IL17f, IL17R, IL17Rb, IL17RC, IL20, IL21, IL22RA, IL23, IL23R, IL31, P, TSLPR, interferon alpha, interferon gamma, B7RP-1, cKit, GMCSF, GMCSFR, CTLA-4, CD2, CD3, CD4, CD11a, CD18, CD20, CD22, CD26L, CD30, TNFRSF5 (CD40), CD80, CD86, CXCR3, CXCR4, CCR2, CCR4, CCR5, CCR8, CCL2, CXCL10, PLGF, PD1, B7-DC (PDL2), B7-H1 (PDL1), alpha4 integrin, A4B7 integrin, C5, RhD, IgE, or Rh. An MRD that binds to one of the above targets is encompassed by the invention. Multivalent and multispecific compositions (e.g., MRD-containing antibodies) having 1, 2, 3, 4, 5, 6, or more MRDs that bind to 1, 2, 3, 4, 5, 6, or more of the above targets are also encompassed by the invention. Thus, the invention encompasses MRD-containing antibodies comprising at least 1, 2, 3, 4, 5, 6, or more MRDs that bind to at least 1, 2, 3, 4, 5, 6 of the above targets.

In particular embodiments, the antibody target of the MRD-containing antibody competes for target binding with: SGN-70 CD70 (Seattle Genetics), SGN-75 CD70 (Seattle Genetics), Belimumab BLYS (e.g., BENLYSTA®, Human Genome Sciences/GlaxoSmithKline), Atacicept BLYS/APRIL (Merck/Serono), TWEAK (e.g., Biogen mAb), TL1A antibodies of CoGenesys/Teva (e.g., hum11D8, hum25B9, and hum1B4 (U.S. Appl. Publ. No. 2009/0280116), OX40 mAb, humAb OX40L (Genentech), rilonacept IL1 trap (e.g., ARCALYST®, Regeneron), catumaxomab IL1beta (e.g., REMOVAB®, Fresenius Biotech GmbH), Xoma052 IL1beta (Lilly), canakinumab IL1beta (e.g., ILARIS® (Novartis) and ACZ885 (Novartis)), AMG108 IL1R (Amgen), daclizumab IL2Ra (e.g., ZENAPAX®, Hoffman-La Roche), basiliximab IL2Ra (e.g., SIMULECT®, Novartis), AMGN-317 IL4a (Amgen), pascolizumab IL4 (PDL), mepolizumab IL5 (e.g., BOSATRIA®, GlaxoSmithKline), reslizumab IL5 (e.g., SCH55700, Ception Therapeutics), benralizumab IL5R (e.g., MEDI-563 MedImmune), BIW-8405, IL5R (BioWa), etanercept TNFR2-fc (e.g., ENBREL®, Amgen), siltuximab IL6 (e.g., CNT0328, Centocor), CNTO136 IL6 (Centocor), CDP-6038 IL6 (UCB), AMGN-220 IL6 (Amgen), REGN-88 IL6R (Regeneron), tocilizumab IL6R (e.g., ACTEMRA™/ROACTEMRA™, Chugai/Roche), MEDI-528 IL9 (MedImmune), briakinumab IL12/13 (e.g., ABT-874, Abbott), ustekinumab IL12, IL23 (e.g., STELARA® and CNTO 1275, Centocor), TNX-650 IL13 (Tanox), lebrikizumab IL13 (Genentech), tralokinumab IL13 (e.g., CAT354, e.g., Cambridge Antibody Technology), AMG714 IL15 (Amgen), CRB-15 IL15R (Hoffman La-Roche), AMG827 IL17R (Amgen), IL17RC antibody of Zymogenetics/Merck Serono, IL20 antibody of Zymogenetics, IL20 antibody of Novo Nordisk, IL21 antibody of Novo Nordisk (e.g., NCT01038674), IL21 antibody Zymogenetics (Zymogenetics), IL22RA antibody of Zymogenetics, IL31 antibody of Zymogenetics, AMG157 TSLP (Amgen), MEDI-545 interferon alpha (MedImmune), MEDI-546 interferon alpha receptor (MedImmune), AMG811 interferon gamma (Amgen), INNO202 interferon gamma (Innogenetics/Advanced Biotherapy), HuZAF interferon-gamma (PDL), AMG557 B7RP1 (Amgen), AMG191 cKit (Amgen), MOR103 GMCSF (MorphoSys), mavrilimumab GMCSFR (e.g., CAM-3001, MedImmune), tremelimumab CTLA4 (e.g., CP-675,206, Pfizer), iplimumab CTLA4 (e.g., MDX-010, BMS/Medarex), alefacept CD2 (e.g., AMEVIVE®, Astellas), siplizumab CD2 (e.g., MEDI-507, MedImmune), otelixizumab CD3 (e.g., TRX4, Tolerx/GlaxoSmithKline), teplizumab CD3 (e.g., MGA031, MacroGenics/Eli Lilly), visilizumab CD3 (e.g., NUVION®, PDL), muromonab-CD3 CD3 (Ortho), ibalizumab (e.g., TMB-355 and TNX-355, TaiMed Biologics), zanolimumab CD4 (e.g., HUMAX-CD4®, Genmab), cedelizumab CD4 (Euroasian Chemicals), keliximab CD4, priliximab CD4 (e.g., cMT412, Centocor), BT-061 CD4 (BioTest AG), efalizumab CD11a (e.g., RAPTIVA®/XANELIM™, Genentech/Roche/Merck-Serono), MLN01 CD18 (Millennium Pharmaceuticals), epratuzumab CD22 (e.g., Amgen antibody) and hLL2; (Immunomedics/UCB)), aselizumab CD26L, iratumumab CD30 (e.g., SGN30 (Seattle Genetics) and MDX-060 (Medarex), SGN40 CD40 (Seattle Genetics), ANTOVA® CD40 ligand (Biogen Idec), abatacept CD80 CD86 (e.g., ORENCIA®, Bristol-Myers Squibb), CT-011 PD1 (Cure Tech), GITR (e.g., TRX518, (Tolerx), AT010 CXCR3 (Affitech), MLN1202 CCR2 (Millennium Pharmaceuticals), AMG-761 CCR4 (Amgen), HGS004 CCR5 (Human Genome Sciences), PRO 140 (Progenies), MDX-1338 CXCR4 (Medarex), CNTO-888 CCL2 (Centocor), ABN912 CCL2 (Novartis), MDX-1100 CXCL10 (Medarex), TB-403 PLGF (BioInvent), natalizumab integrin Alpha4 subunit (e.g., TYSABRI®, Biogen Idec/Elan), vedolizumab integrin A4B7 (e.g., MLN2, Millennium Pharmaceuticals/Takeda), eculizumab C5 Compliment (e.g., SOLIRIS®, Alexion), pexelizumab C5 Compliment (Alexion), omalizumab IgE (e.g., XOLAIR®, Genentech/Roche/Novartis), talizumab (e.g., TNX-901, Tanox), toralizumab (IDEC 131, IDEC), bertilimumab eotaxin (e.g., iCo-008, iCos Therapeutics Inc.), ozrolimupab RhD (e.g., Sym001, Symphogen A/S), atorolimumab or morolimumab (Rh factor). An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention. Thus, the invention encompasses MRD-containing antibodies comprising at least 1, 2, 3, 4, 5, 6, or more MRDs that compete for target binding with at least 1, 2, 3, 4, 5 or 6 of the above antibodies.

In particular embodiments, the antibody of the MRD-containing antibody is: SGN-70 CD70 (Seattle Genetics), SGN-75 CD70 (Seattle Genetics), Belimumab BLYS (e.g., BENLYSTA®, Human Genome Sciences/GlaxoSmithKline), BIIB023 TWEAK (Biogen Idec), TL1A antibodies of CoGenesys/Teva (e.g., 11 D8, 25B9, and 1B4 (U.S. Appl. Publ. No. 2009/0280116), OX40 mAb, humAb OX40L (Genentech), catumaxomab IL1beta (e.g., REMOVAB®, Fresenius Biotech GmbH), canakinumab IL1beta (e.g., ILARIS® (Novartis) and ACZ885 (Novartis)), AMG108 IL1R (Amgen), daclizumab IL2Ra (e.g., ZENAPAX®, Hoffman-La Roche), basiliximab IL2Ra (e.g., SIMULECT®, Novartis), AMGN-317 IL4a (Amgen), pascolizumab IL4 (PDL), mepolizumab IL5 (e.g., BOSATRIA®, GlaxoSmithKline), reslizumab IL5 (e.g., SCH55700, Ception Therapeutics), benralizumab IL5R (e.g., MEDI-563, MedImmune), BIW-8405, IL5R (BioWa), siltuximab IL6 (e.g., CNT0328, Centocor), CNTO-136 IL6 (Centocor), CDP-6038 IL6 (UCB), AMGN-220 IL6 (Amgen), REGN-88 IL6R (Regeneron), tocilizumab IL6R (e.g., ACTEMRA™/ROACTEMRA™, Chugai/Roche), MEDI-528 IL9 (MedImmune), briakinumab IL12/13 (e.g., ABT-874, Abbott), ustekinumab IL12, IL23 (e.g., CNTO 1275, Centocor), lebrikizumab IL13 (Genentech), TNX-650 IL13 (Tanox), CAT354 IL13 (Cambridge Antibody Technology), AMG714 IL15 (Amgen), CRB-15 IL15R (Hoffman La-Roche), AMG827 IL17R (Amgen), IL17RC antibody of Zymogenetics/Merck Serono, IL20 antibody of Zymogenetics, IL20 antibody of Novo Nordisk, IL21 antibody of Novo Nordisk, IL21 antibody Zymogenetics (Zymogenetics), IL22RA antibody of Zymogenetics, IL31 antibody of Zymogenetics, AMG157 TSLP (Amgen), MEDI-545 interferon alpha (MedImmune), MEDI-546 interferon alpha receptor (MedImmune), AMG811 interferon gamma (Amgen), INNO202 interferon gamma (Innogenetics/Advanced Biotherapy), HuZAF interferon-gamma (PDL), AMG557B7RP1 (Amgen), AMG191 cKit (Amgen), MOR103 GMCSF (MorphoSys), CAM-3001 GMCSFR (MedImmune), tremelimumab CTLA4 (e.g., CP-675,206, Pfizer), iplimumab CTLA4 (e.g., MDX-010, BMS/Medarex), siplizumab CD2 (e.g., MEDI-507, MedImmune), otelixizumab CD3 (e.g., TRX4, Tolerx/GlaxoSmithKline), muromonab-CD3 CD3 (Ortho), teplizumab CD3 (e.g., MGA031, MacroGenics/Eli Lilly), visilizumab CD3 (e.g., NUVION®, PDL), zanolimumab CD4 (e.g., HUMAX-CD4®, Genmab), cedelizumab CD4 (Euroasian Chemicals), keliximab CD4, priliximab CD4 (e.g., cMT412, Centocor), BT-061 CD4 (BioTest AG), ibalizumab (e.g., TMB-355 and TNX-355, TaiMed Biologics), efalizumab CD11a (e.g., RAPTIVA®/XANELIM™, Genentech/Roche/Merck-Serono), MLN01 CD18 (Millennium Pharmaceuticals), epratuzumab CD22 (e.g., Amgen antibody) and hLL2 (Immunomedics/UCB)), aselizumab CD26L iratumumab CD30 (e.g., SGN30 (Seattle Genetics) and MDX-060 (Medarex), SGN40 CD40 (Seattle Genetics), ANTOVA® CD40 ligand (Biogen Idec), CT-011 PD1 (Cure Tech), AT010 CXCR3 (Affitech), MLN3897 CCR1 (Millennium Pharmaceuticals), MLN1202 CCR2 (Millennium Pharmaceuticals), AMG-761 CCR4 (Amgen), HGS004 CCR5 (Human Genome Sciences), PRO 140 (Progenies), MDX-1338 CXCR4 (Medarex), CNTO-888 CCL2 (Centocor), ABN912 CCL2 (Novartis), MDX-1100 CXCL10 (Medarex), TB-403 PLGF (BioInvent), natalizumab integrin Alpha4 subunit (e.g., TYSABRI®, Biogen Idec/Elan), vedolizumab integrin A4B7 (e.g., MLN02, Millennium Pharmaceuticals/Takeda), eculizumab C5 Compliment (e.g., SOLIRIS®, Alexion pharmaceuticals), omalizumab IgE (e.g., XOLAIR®, Genentech/Roche/Novartis), talizumab (e.g., TNX-901, Tanox), toralizumab (IDEC 131, IDEC), bertilimumab eotaxin (e.g., iCo-008, iCo Therapeutics Inc.), ozrolimupab RhD (e.g., Sym001, Symphogen A/S), atorolimumab or morolimumab (Rh factor).

In additional embodiments, the antibody target of the MRD-containing antibody competes for target binding with an antibody selected from: oxelumab (e.g., RG4930; Genmab), AMG139 (Amgen), AMG181 (Amgen), CNTO 148 TNF (Medarex), an anti-TNF antibody described in U.S. Pat. No. 6,258,562 (BASF), Humicade® TNF (Celltech), HuM291 CD3 fc receptor (PDL), Mik-beta-1 IL-2Rb (CD122) (Hoffman LaRoche), REGN668 IL-4R (Regeneron), sarilumab IL-6R (e.g., REGN88, Regeneron), HuMax-Inflam IL-8 (e.g., HuMax-Inflam™/MDX-018; Genmab and Medarex), anti-IL-12 and/or anti-IL-12p40 antibody disclosed in U.S. Pat. No. 6,914,128 (Abbott), HuMax-IL15 IL15 (Medarex and Genmab), ABX-IL8 IL8 (Abgenix), an anti-IL-18 antibody disclosed in US Appl. Pub. No. 2005/0147610 (Abbott), hCBE-11 LTBR (Biogen), HuMax-TAC IL-2Ra (CD25) (Genmab, see, e.g., Intl. Appl. Publ. No. WO2004045512, MLN01 Beta2 integrin (Xoma), D3H44 ATF (Genentech), MT203 GMCSF (e.g., namilumab, Micromet and Takeda), IFX1/CaCP29 (InflaRx GmbH), CAT-213 Eotaxin 1 (Cambridge Antibody Technologies), MDX-018 IL-8 (e.g., HuMax-Inflam™; Medarex), REGN846 IL-4R (Regeneron, see, e.g., US Appl. Pub. No. 20100291107), REGN728 (Regeneron), RGN846 (Regeneron), T2-18C3 IL1A (MABp1; XBiotech), RA-18C3 IL1A (XBiotech) and CV-18C3 IL1A (XBiotech). An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, 5, 6, or more of the above antibodies are also encompassed by the invention. Thus, the invention encompasses MRD-containing antibodies comprising at least 1, 2, 3, 4, 5, 6, or more MRDs that compete for target binding with at least 1, 2, 3, 4, 5, or 6 of the above antibodies.

In additional embodiments, one of the above-described antibodies is the antibody of the MRD-containing antibody.

In an additional embodiment, the antibody in the MRD-containing antibody specifically binds CTLA4. In a specific embodiment, the antibody is tremelimumab (e.g., CP-675, 206, Pfizer). In another embodiment, the antibody binds to the same epitope as tremelimumab. In a further embodiment, the antibody competitively inhibits binding of tremelimumab to CTLA4. In an additional specific embodiment, the antibody is ipilimumab (e.g., MDX-010, Bristol-Myers Squibb/Medarex). In one embodiment, the antibody binds to the same epitope as ipilimumab. In a further embodiment, the antibody competitively inhibits binding of ipilimumab to CTLA4. Multivalent and multispecific compositions (e.g., MRD-containing antibodies) having 1, 2, 3, 4, 5, 6, or more MRDs that compete for CTLA4 binding with tremelimumab or ipilimumab are also encompassed by the invention.

In an additional embodiment, the antibody in the MRD-containing antibody specifically binds TNFSF12 (TWEAK). In a specific embodiment, the antibody is the TWEAK antibody of Biogen that has advanced to Phase I clinical trials. In another embodiment, the antibody binds to the same epitope as the Biogen TWEAK antibody. In a further embodiment, the antibody competitively inhibits binding of the Biogen TWEAK antibody to TWEAK. Multivalent and multispecific compositions (e.g., MRD-containing antibodies) having 1, 2, 3, 4, 5, 6, or more MRDs that compete for TWEAK binding with the Biogen TWEAK antibody are also encompassed by the invention.

In an additional embodiment, the antibody in the MRD-containing antibody specifically binds IL2Ra (CD25). In a specific embodiment, the antibody is daclizumab (e.g., ZENAPAX®). In another embodiment, the antibody binds to the same epitope as daclizumab. In a further embodiment, the antibody competitively inhibits binding of daclizumab to IL2Ra (CD25). Multivalent and multispecific compositions (e.g., MRD-containing antibodies) having 1, 2, 3, 4, 5, 6, or more MRDs that compete for IL2Ra (CD25) binding with daclizumab are also encompassed by the invention.

In an additional embodiment, the antibody in the MRD-containing antibody specifically binds CD40 (TNFRSF5). In a specific embodiment, the antibody is CP-870893 CD40 (Pfizer). In another embodiment, the antibody binds to the same epitope as CP-870893. In a further embodiment, the antibody competitively inhibits binding of CP-870893 to CD40. Multivalent and multispecific compositions (e.g., MRD-containing antibodies) having 1, 2, 3, 4, 5, 6, or more MRDs that compete for CD40 binding with CP-870893 are also encompassed by the invention.

In an additional embodiment, the antibody in the MRD-containing antibody specifically binds Alpha4 integrin. In a specific embodiment, the antibody is natalizumab (e.g., TYSABRI®; Biogen Idec/Elan). In one embodiment, the antibody binds to the same epitope as natalizumab. In a further embodiment, the antibody competitively inhibits binding of natalizumab to Alpha4 integrin. Multivalent and multispecific compositions (e.g., MRD-containing antibodies) having 1, 2, 3, 4, 5, 6, or more MRDs that compete for Alpha4 integrin binding with natalizumab are also encompassed by the invention.

In an additional embodiment, the antibody in the MRD-containing antibody specifically binds IL22. In a specific embodiment, the antibody is PF-5,212,367 (ILV-094) (Pfizer). In another embodiment, the antibody binds to the same epitope as PF-5,212,367. In a further embodiment, the antibody competitively inhibits binding of PF-5,212,367 to IL22. Multivalent and multispecific compositions (e.g., MRD-containing antibodies) having 1, 2, 3, 4, 5, 6, or more MRDs that compete for IL22 binding with PF-5,212,367 are also encompassed by the invention.

In an additional embodiment, the antibody in the MRD-containing antibody specifically binds MAdCAM. In a specific embodiment, the antibody is PF-547,659 (Pfizer). In another embodiment, the antibody binds to the same epitope as PF-547,659. In a further embodiment, the antibody competitively inhibits binding of PF-547,659 to MAdCAM. Multivalent and multispecific compositions (e.g., MRD-containing antibodies) having 1, 2, 3, 4, 5, 6, or more MRDs that compete for MAdCAM binding with PF-547,659 are also encompassed by the invention.

In one embodiment, the antibody in the MRD-containing antibody specifically binds TNF. In a specific embodiment, the antibody is adalimumab (e.g., HUMIRA®/TRUDEXA®, Abbott). In one embodiment, the antibody binds to the same epitope as adalimumab. In another embodiment, the antibody competitively inhibits binding of adalimumab to TNF. In another specific embodiment, the antibody is ATN-103 (Pfizer). In one embodiment, the antibody binds to the same epitope as ATN-103. In another embodiment, the antibody competitively inhibits binding of ATN-103 to TNF. In another specific embodiment, the antibody is infliximab. In one embodiment, the antibody binds to the same epitope as infliximab. In another embodiment, the antibody competitively inhibits binding of infliximab to TNF. In another specific embodiment, the antibody is selected from: certolizumab (e.g., CIMZIA®, UCB), golimumab (e.g., SIM- PONI™, Centocor), and AME-527 (Applied Molecular Evolution). In one embodiment, the antibody binds to the same epitope as certolizumab, golimumab, or AME-527. In another embodiment, the antibody competitively inhibits binding of certolizumab, golimumab, or AME-527, to TNF. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, 3, 4, or 5, of the above antibodies are also encompassed by the invention.

In some embodiments, the antibody in the MRD-containing antibody comprises the CDRs of the anti-TNF antibody adalimumab. The CDR, VH, and VL sequences of adalimumab are provided in Table 3.

TABLE 3

| CDR | Sequence |
| --- | --- |
| VL-CDR1 | RASQGIRNYLA (SEQ ID NO: 80) |
| VL-CDR2 | AASTLQS (SEQ ID NO: 81) |
| VL-CDR3 | QRYNRAPYT (SEQ ID NO: 82) |
| VH-CDR1 | DYAMH (SEQ ID NO: 83) |
| VH-CDR2 | AITWNSGHIDYADSVEG (SEQ ID NO: 84) |
| VH-CDR3 | VSYLSTASSLDY (SEQ ID NO: 85) |
| VL | DIQMTQSPSSLSASVGDRVTITCRASQGIRNYLAWYQQKPGK APKLLIYAASTLQSGVPSRFSGSGSGTDFTLTISSLQPEDVA TYYCQRYNRAPYTFGQGTKVEIKR (SEQ ID NO: 86) |
| VH | EVQLVESGGGLVQPGRSLRLSCAASGFTFDDYAMHWVRQAPG KGLEWVSAITWNSGHIDYADSVEGRFTISRDNAKNSLYLQMN SLRAEDTAVYYCAKVSYLSTASSLDYWGQGTLVTVSS (SEQ ID NO: 87) |

In one embodiment, an MRD-containing antibody binds TNF (i.e., TNF alpha) and additionally binds a target selected from: Te38, IL12, IL12p40, IL13, TL15, IL17, IL18, IL1beta, IL23, MIF, PGE2, PGE4, VEGF, TNFSF11 (RANKL), TNFSF13B (BLYS), GP130, CD22 and CTLA-4. In another embodiment, an MRD-containing antibody binds TNF alpha, IL6, and TNFSF13B (BLYS). In another embodiment, an MRD-containing antibody binds TNF alpha and TNFSF12 (TWEAK). In additional embodiments, the MRD-containing antibody binds TNF and TNFSF15 (TL1A). In another embodiment, an MRD-containing antibody binds TNF and additionally binds a target selected from NGF, SOST (sclerostin), LPA, IL17A, DKK, alpha Vbeta3, IL23p19, IL2, IL2RA (CD25), IL6, IL6R, IL12p40, IL6, IL10, IL21, IL22 and CD20 binds TNF. Multivalent and multispecific compositions (e.g., MRD-containing antibodies) that bind TNF alpha and at least 1, 2, 3, 4, 5 or more of these targets are also encompassed by the invention. In specific embodiments, the antibody component of the MRD-containing antibody binds TNF alpha. In further embodiments, the antibody component of the MRD-containing antibody is adalimumab, infliximab certolizumab golimumab, CNTO 148, AME-527 or ATN-103.

In other embodiments, the target of the antibody of the MRD-containing antibody is IL6. In some embodiments, the antibody of the MRD-containing antibody is siltuximab (CNT0328, Centocor), CNTO-136 (Centocor), CDP-6038 (UCB), or AMGN-220 (Amgen). In other embodiments, the antibody of the MRD-containing antibody competes with siltuximab (CNT0328, Centocor), CNTO-136 (Centocor), CDP-6038 (UCB), or AMGN-220 (Amgen) for binding to IL6. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2, or more of the above antibodies are also encompassed by the invention.

In one embodiment, an MRD-containing antibody binds IL6. In a specific embodiment, an MRD-containing antibody binds IL6 and a target selected from: IL1, IL1beta, IL1Ra, IL5, CD8, TNFRSF5 (CD40), PDL1, IL6R, IL17A, TNF, VEGF, TNFSF11 (RANKL) and PGE2. Multivalent and multispecific compositions (e.g., MRD-containing antibodies) that bind IL6 and also bind at least 1, 2, 3, 4, 5 or more of these targets are also encompassed by the invention. In specific embodiments, the antibody component of the MRD-containing antibody binds IL6. In further embodiments, the antibody component of the MRD-containing antibody is siltuximab, CNTO136, CDP-6038 or AMGN-220.

In other embodiments, the target of the antibody of the MRD-containing antibody is IL6R. In some embodiments, the antibody of the MRD-containing antibody is REGN-88 (Regeneron) or tocilizumab (ACTEMRA™/RO-ACTEMRA™, Chugai/Roche). In other embodiments, the antibody of the MRD-containing antibody competes with siltuximab, REGN-88 (Regeneron) or tocilizumab (ACTEMRA™/ROACTEMRA™, Chugai/Roche) for binding to IL6R. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1 or both of the above antibodies are also encompassed by the invention.

In one embodiment, an MRD-containing antibody binds IL6R. In a specific embodiment, an MRD-containing antibody binds IL6R and a target selected from: CD8, TNFRSF5 (CD40), PDL1, IL6, IL17A, TNF, VEGF, TNFSF11 (RANKL) and PGE2. Multivalent and multispecific compositions (e.g., MRD-containing antibodies) that bind IL6R and also bind at least 1, 2, 3, 4, 5 or more of these targets are also encompassed by the invention. In specific embodiments, the antibody component of the MRD-containing antibody binds IL6R. In further embodiments, the antibody component of the MRD-containing antibody is REGN-88 or tocilizumab.

In some embodiments, an MRD-containing antibody binds TNFSF15 (TL1A). In further embodiments, the MRD-containing antibody binds TL1A and a target selected from: TNF, IFN alpha, IFN gamma, IL1, IL1beta, IL6, IL8, IL12, IL15, IL17, IL18, IL23 and IL32. Multivalent and multispecific compositions (e.g., MRD-containing antibodies) that bind TL1A and also bind at least 1, 2, 3, 4, 5 or more of these targets are also encompassed by the invention. These compositions have applications in treating diseases and disorders including inflammatory bowel disease and autoimmune diseases such as rheumatoid arthritis. In specific embodiments, the antibody component of the MRD-containing antibody binds TL1a.

In some embodiments, an MRD-containing antibody binds interferon alpha. In further embodiments, the MRD-containing antibody binds interferon alpha and TNFSF13B (BLYS). In further embodiments, the MRD-containing antibody binds interferon alpha, TNFSF13B (BLYS), and a neutrophil extracellular trap (NET). These compositions have applications in treating diseases and disorders including autoimmune diseases such as rheumatoid arthritis and systemic lupus erythematous. In specific embodiments, the antibody component of the MRD-containing antibody binds interferon alpha.

The multivalent and multispecific compositions of the invention also have applications in treating neurologic diseases or disorders including neurodegenerative diseases, pain and neural injury or trauma. In particular embodiments, the target of the antibody of the MRD-containing antibody is: amyloid beta (Abeta), beta amyloid, complement factor D, PLP, ROBO4, ROBO, GDNF, NGF, LINGO, or myostatin. In specific embodiments, the antibody in the MRD-containing antibody is gantenerumab (e.g., R1450, Hoffman La-Roche), bapineuzumab beta amyloid 9 (Elan and Pfizer), solanezumab beta amyloid 9 (Eli Lilly), tanezumab NGF (e.g., RN624, Pfizer), BIIB033 LINGO (Biogen Idec), PF-3,446,879 myostatin (Pfizer), or stamulumab myostatin (Wyeth). In a particular embodiment, the antibody in the MRD-containing antibody is fulranumab (e.g., AMG-403; Amgen/Millennium. In another embodiment, the antibody specifically binds to the same epitope as gantenerumab, bapineuzumab, solarezumab, tanezumab, the Biogen LINGO antibody, or stamulumab. In a further embodiment, the antibody specifically binds to the same epitope as fulranumab. In another embodiment, the antibody in the MRD-containing antibody is an antibody that competitively inhibits target binding by gantenerumab, bapineuzumab, solarezumab, tanezumab, BIIB033, or stamulumab. In another embodiment, the antibody in the MRD-containing antibody is an antibody that competitively inhibits NGF binding by fulranumab. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In an additional embodiment, the target of the antibody of the MRD-containing antibody is beta amyloid. In a specific embodiment, the antibody in the MRD-containing antibody is RN1219 (PF-4,360,365; Pfizer). In another embodiment, the antibody specifically binds to the same epitope as RN1219. In a further embodiment, the antibody in the MRD-containing antibody is an antibody that competitively inhibits beta amyloid binding by RN1219. An MRD that competes for beta amyloid binding with RN1219 is also encompassed by the invention. Multivalent and multispecific compositions (e.g., MRD-containing antibodies) having 1, 2, 3, 4, 5, 6, or more MRDs that compete for beta amyloid binding with RN1219 are also encompassed by the invention.

In an additional embodiment, the target of the antibody of the MRD-containing antibody is NGF. In a specific embodiment, the antibody in the MRD-containing antibody is tanezumab (e.g., RN624, Pfizer). In another embodiment, the antibody specifically binds to the same epitope as tanezumab. In a further embodiment, the antibody in the MRD-containing antibody is an antibody that competitively inhibits NGF binding by tanezumab. An MRD that competes for NGF binding with tanezumab is also encompassed by the invention. Multivalent and multispecific compositions (e.g., MRD-containing antibodies) having 1, 2, 3, 4, 5, 6, or more MRDs that compete for NGF binding with tanezumab are also encompassed by the invention.

In a specific embodiment, an MRD-containing antibody binds NGF and a target selected from: MTX, NKG2D, RON, IL6R, ErbB3, TNFRSF21 (DR6), CD3, IGFR, DLL4, P1GF, CD20, EGFR, HER2, CD19, CD22, TNFRSF5 (CD40), CD80, cMET, NRP1, TNF, LINGO, HGF, IGF1, IGF1,2, IGF2, NGF, Te38, NogoA, RGM A, MAG, OMGp, NgR, TNFSF12 (TWEAK), PGE2, IL1 beta, Semaphorin 3A and Semaphorin 4. Multivalent and multispecific compositions (e.g., MRD-containing antibodies) that bind NGF and also bind at least 1, 2, 3, 4, 5 or more of these targets are also encompassed by the invention. In specific embodiments, the antibody component of the MRD-containing antibody binds NGF. In further embodiments, the antibody component of the MRD-containing antibody is tanezumab. In additional embodiments, the antibody component of the MRD-containing antibody competes for NGF binding with tanezumab. In further embodiments, the antibody component of the MRD-containing antibody is MEDI-578. In additional embodiments, the antibody component of the MRD-containing antibody competes for NGF binding with MEDI-578.

In an additional embodiment, the target of the antibody of the MRD-containing antibody is LINGO (e.g., LINGO1). In a specific embodiment, the antibody in the MRD-containing antibody is BIIB033 (Biogen Idec). In another embodiment, the antibody specifically binds to the same epitope as BIIB033. In a further embodiment, the antibody in the MRD-containing antibody is an antibody that competitively inhibits LINGO binding by BIIB033. An MRD that competes for LINGO binding with BIIB033 is also encompassed by the invention. Multivalent and multispecific compositions (e.g., MRD-containing antibodies) having 1, 2, 3, 4, 5, 6, or more MRDs that compete for LINGO binding with BIIB033 are also encompassed by the invention.

In a specific embodiment, an MRD-containing antibody binds LINGO and a target selected from: MTX, NKG2D, RON, IL6R, ErbB3, TNFRSF21 (DR6), CD3, IGFR, DLL4, P1GF, CD20, EGFR, HER2, CD19, CD22, TNFRSF5 (CD40), CD80, cMET, NRP1, TNF, TNFSF12 (TWEAK), HGF, IGF1, IGF1,2, IGF2, NGF, Te38, NogoA, RGM A, MAG, OMGp, NgR, NGF, PGE2, IL1 beta, Semaphorin 3A and Semaphorin 4. Multivalent and multispecific compositions (e.g., MRD-containing antibodies) that bind LINGO and also bind at least 1, 2, 3, 4, 5 or more of these targets are also encompassed by the invention. In specific embodiments, the antibody component of the MRD-containing antibody binds LINGO. In further embodiments, the antibody component of the MRD-containing antibody is BIIB033.

In a specific embodiment, the target of an antibody of an MRD-containing antibody is TNFSF12 (TWEAK). In another embodiment, the antibody in the MRD-containing antibody binds TNFSF12 (TWEAK) and a target selected from: MTX, NKG2D, RON, IL6R, ErbB3, TNFRSF21 (DR6), CD3, IGFR, DLL4, P1GF, CD20, EGFR, HER2, CD19, CD22, TNFRSF5 (CD40), CD80, cMET, NRP1, TNF, LINGO, HGF, IGF1, IGF1,2, IGF2, NGF, Te38, NogoA, RGM A, MAG, OMGp, NgR, NGF, PGE2, IL1 beta, Semaphorin 3A and Semaphorin 4. Multivalent and multispecific compositions (e.g., MRD-containing antibodies) that bind TNFSF12 (TWEAK) and also bind at least 1, 2, 3, 4, 5 or more of these targets are also encompassed by the invention. In specific embodiments, the antibody component of the MRD-containing antibody binds TNFSF12 (TWEAK). In further embodiments, the antibody component of the MRD-containing antibody is BIIB023.

In another embodiment, the target of the antibody of the MRD-containing antibody is: oxidized LDL, gpIIB, gpIIIa, PCSK9, Factor VIII, integrin a2bB3, AOC3, or mesothelin. In specific embodiments, the antibody in the MRD-containing antibody is BI-204 oxidized LDL (BioInvent), abciximab gpIIB, gpIIIa (e.g., REOPRO, Eli Lilly), AMG-145 PCSK9 (Amgen), TB-402 Factor VIII (BioInvent), vapaliximab, or tadocizumab integrin a2bB3 (Yamonochi Pharma). In another embodiment, the antibody specifically binds to the same epitope as BI-204, abciximab, AMG-145, TB-402, or tadocizumab. In another embodiment, the antibody in the MRD-containing antibody is an antibody that competitively inhibits binding of BI-204, abciximab, AMG-145, TB-402, vapaliximab, or tadocizumab. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In other embodiments, the antibody of the MRD-containing antibody is associated with bone growth and/or metabolism. In certain embodiments the antibody target of the MRD-containing antibody is TNFSF11 (RANKL). In other embodiments the antibody target of the MRD-containing antibody is: DKK1, osteopontin, cathepsin K, TNFRSF19L (RELT), TNFRSF19 (TROY), or sclerostin (CDP-7851 UCB Celltech). In another embodiment antibody target of the MRD-containing antibody is TNFSF11 (RANKL). In a specific embodiment, the antibody in the MRD-containing antibody is denosumab (e.g., AMG-162, Amgen). In another embodiment, the antibody specifically binds to the same epitope as denosumab. In another embodiment, the antibody in the MRD-containing antibody is an antibody that competitively inhibits binding of TNFSF11 (RANKL) by denosumab. In another specific embodiment, the antibody is AMG617 or AMG785 (e.g., CDP7851, Amgen). In another embodiment, the antibody specifically binds to the same epitope as AMG617 or AMG785. In another embodiment, the antibody in the MRD-containing antibody is an antibody that competitively inhibits binding of sclerostin by AMG617 or AMG785. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In one embodiment, an MRD-containing antibody binds TNFSF11 (RANKL). In a specific embodiment, an MRD-containing antibody binds TNFSF11 and a target selected from: sclerostin (SOST), endothelin-1, DKK1, IL1, IL6, IL7, IL8, IL11, IL17A, MCSF, IGF1, IGF2, IGF1,2 IGF1R, TNF, FGF1, FGF2, FGF4, FGF7, FGF8a, FGF8b, FGF18, FGF19, FGFR1 (e.g., FGFR1-IIIC), FGFR2 (e.g., FGFR2-IIIa, FGFR2-IIIb, and FGFR2-IIIc), FGFR3, TGF beta, TGF beta R2, BMP2, BMP4, BMP5, BMP9, BMP10, BMPR-IA, PDGF, PDGFRa, PDGFRb PTH, PTH related protein (PTHrP), and PGE2. In a particular embodiment, the MRD-containing antibody binds TNFSF11 and DKK1. In a further embodiment the antibody of the MRD-containing antibody binds DKK1. Multivalent and multispecific compositions (e.g., MRD-containing antibodies) that bind TNFSF11 and also bind at least 1, 2, 3, 4, 5 or more of these targets are also encompassed by the invention. In specific embodiments, the antibody component of the MRD-containing antibody binds TNFSF11. In further embodiments, the antibody component of the MRD-containing antibody is denosumab, AMG617 or AMG785.

In additional embodiments, the antibody target of the MRD-containing antibody is a bacterial antigen, a viral antigen, a mycoplasm antigen, a prion antigen, or a parasite antigen (e.g., one infecting a mammal).

In other embodiments, the target of the antibody of the MRD-containing antibody is a viral antigen. In one embodiment, the target of the antibody of the MRD-containing antibody is anthrax, hepatitis b, rabies, Nipah virus, west nile virus, a mengititis virus, or CMV. In other embodiments, the antibody of the MRD-containing antibody competes with antigen binding with ABTHRAX® (Human Genome Sciences), exbivirumab, foravirumab, libivirumab, rafivirumab, regavirumab, sevirumab (e.g., MSL-109, Protovir), tuvirumab, raxibacumab, Nipah virus M102.4, or MGAWN1® (MacroGenics) for target binding. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In other embodiments, the target of the antibody of the MRD-containing antibody is RSV. In other embodiments, the antibody of the MRD-containing antibody is motavizumab (e.g., NUMAX®, MEDI-577; MedImmune) or palivizumab RSV fusion f protein (e.g., SYNAGIS®, MedImmune). In other embodiments, the antibody of the MRD-containing antibody competes with motavizumab or palivizumab RSV fusion f protein, for target binding. In other embodiments, the antibody of the MRD-containing antibody is felvizumab. In other embodiments, the antibody of the MRD-containing antibody competes with felvizumab for target binding. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In other embodiments, the target of the antibody of the MRD-containing antibody is a bacterial or fungal antigen. In other embodiments, the antibody of the MRD-containing antibody competes for antigen binding with nebacumab, edobacomab (e.g., E5), tefibazumab (Inhibitex), panobacumab (e.g., KBPA101, Kenta), pagibaximab (e.g., BSYX-A110, Biosynexus), urtoxazumab, or efungumab (e.g., MYCOGRAB®, Novartis). In other embodiments, the antibody of the MRD-containing antibody is nebacumab, edobacomab, tefibazumab (Inhibitex), panobacumab, pagibaximab, urtoxazumab, or efungumab. An MRD that competes for target binding with one of the above antibodies is also encompassed by the invention. Multivalent and multispecific compositions (e.g., MRD-containing antibodies) having 1, 2, 3, 4, 5, 6, or more MRDs that compete for target binding with 1, 2 or more of the above antibodies are also encompassed by the invention.

In another specific embodiment, the antibody in the MRD-containing antibody is the catalytic antibody 38C2. In another embodiment, the antibody binds to the same epitope as 38C2. In another embodiment, the antibody competitively inhibits 38C2.

Other antibodies of interest include A33 binding antibodies. Human A33 antigen is a transmembrane glycoprotein of the Ig superfamily. The function of the human A33 antigen in normal and malignant colon tissue is not yet known. However, several properties of the A33 antigen suggest that it is a promising target for immunotherapy of colon cancer. These properties include (i) the highly restricted expression pattern of the A33 antigen, (ii) the expression of large amounts of the A33 antigen on colon cancer cells, (iii) the absence of secreted or shed A33 antigen, (iv) the fact that upon binding of antibody A33 to the A33 antigen, antibody A33 is internalized and sequestered in vesicles, and (v) the targeting of antibody A33 to A33 antigen expressing colon cancer in preliminary clinical studies. Fusion of a MRD directed toward A33 to a catalytic or non-catalytic antibody would increase the therapeutic efficacy of A33 targeting antibodies.

In some embodiments, the antibody in the MRD-containing antibody binds to a human target protein. In some embodiments, the MRD binds to both a human protein and its ortholog in mouse, rat, rabbit, or hamster.

The antibodies in the multivalent and multispecific compositions (e.g., MRD-containing antibodies) are able to bind their respective targets when the MRDs are attached to the antibody. In certain embodiments, the antibody binds its target independently. In some embodiments, the antibody is a target agonist. In other embodiments, the antibody is a target antagonist. In certain embodiments, the antibody can be used to localize an MRD-containing antibody to an area where the antibody target is located.

It is contemplated that the antibodies used in the present invention may be prepared by any method known in the art. For example, antibody molecules and multivalent and multispecific compositions (e.g., MRD-containing antibodies) can be "recombinantly produced," i.e., produced using recombinant DNA technology.

Monoclonal antibodies that can be used as the antibody component of the multivalent and multispecific compositions (e.g., MRD-containing antibodies) can be prepared using hybridoma methods, such as those described by Kohler and Milstein, Nature 256:495 (1975). Using the hybridoma method, a mouse, hamster, or other appropriate host animal, is immunized as described above to elicit the production by lymphocytes of antibodies that will specifically bind to an immunizing antigen. Lymphocytes can also be immunized in vitro. Following immunization, the lymphocytes are isolated and fused with a suitable myeloma cell line using, for example, polyethylene glycol, to form hybridoma cells that can then be selected away from unfused lymphocytes and myeloma cells. Hybridomas that produce monoclonal antibodies directed specifically against a chosen antigen as determined by immunoprecipitation, immunoblotting, or by an in vitro binding assay (e.g., radioimmunoassay (RIA); enzyme-linked immunosorbent assay (ELISA)) can then be propagated either in vitro, for example, using known methods (see, e.g., Goding, Monoclonal Antibodies: Principles and Practice, Academic Press, 1986) or in vivo, for example, as ascites tumors in an animal. The monoclonal antibodies can then be purified from the culture medium or ascites fluid as described for polyclonal antibodies above.

Alternatively monoclonal antibodies can also be made using recombinant DNA methods, for example, as described in U.S. Pat. No. 4,816,567. For example, in one approach polynucleotides encoding a monoclonal antibody are isolated from mature B-cells or hybridoma cell, such as by RT-PCR using oligonucleotide primers that specifically amplify the genes encoding the heavy and light chains of the antibody, and their sequence is determined using conventional procedures. The isolated polynucleotides encoding the heavy and light chains are then cloned into suitable expression vectors, which when transfected into host cells such as E. coli cells, simian COS cells, Chinese hamster ovary (CHO) cells, or myeloma cells that do not otherwise produce immunoglobulin protein, monoclonal antibodies are generated by the host cells. In other approaches, recombinant monoclonal antibodies or antibody fragments having the desired immunoreactivity can be isolated from phage display libraries expressing CDRs of the desired species using techniques known in the art (McCafferty et al., Nature 348:552-554 (1990); Clackson et al., Nature 352:624-628 (1991); and Marks et al., J. Mol. Biol. 222:581-597 (1991)).

The polynucleotide(s) encoding a monoclonal antibody can further be modified in a number of different ways, using recombinant DNA technology to generate alternative antibodies. For example, polynucleotide sequences that encode one or more MRDs and optionally linkers, can be operably fused, for example, to the 5' or 3' end of sequence encoding monoclonal antibody sequences. In some embodiments, the constant domains of the light and heavy chains of, for example, a mouse monoclonal antibody can be substituted (1) for those regions of for example, a human antibody to generate a chimeric antibody or (2) for a non-immunoglobulin polypeptide to generate a fusion antibody. Techniques for site-directed and high-density mutagenesis of the variable region are known in the art and can be used to optimize specificity, affinity, etc. of a monoclonal antibody.

In certain embodiments, the antibody of the MRD-containing antibody is a human antibody. For example, human antibodies can be directly prepared using various techniques known in the art. Immortalized human B lymphocytes immunized in vitro or isolated from an immunized individual that produce an antibody directed against a target antigen can be generated (See, e.g., Cole et al., Monoclonal Antibodies and Cancer Therapy, Alan R. Liss, p. 77 (1985); Boemer et al., J. Immunol. 147 (1):86-95 (1991); and U.S. Pat. Nos. 5,750,373 and 6,787,637). In one embodiment, the human antibody can be derived from the "minilocus approach" in which an exogenous Ig locus is mimicked through inclusion of individual genes from the Ig locus (see e.g., U.S. Pat. No. 5,545,807). Methods of preparing a human antibody from a phage library, and optionally optimizing binding affinity are known in the art and described, for example, in Vaughan et al., Nat. Biotech. 14:309-314 (1996); Sheets et al., Proc. Nat'l. Acad. Sci. 95:6157-6162 (1998); Hoogenboom et al., Nat. Biotechnology 23:1105-1116 (2005); Hoogenboom et al., J. Mol. Biol. 227:381 (1991); Persic et al., Gene 187:9-18 (1997); Jostock et al., J. Immunol. Methods 289:65-80 (2004); Marks et al., J. Mol. Biol., 222:581 (1991)); et al., Proc. Natl. Acad. Sci. USA, 88:7978-7982 (1991); et al., Proc. Natl. Acad. Sci. USA 91:3809-3813 (1994); Yang et al., J. Mol. Biol. 254:392-403 (1995); and Barbas et al., Proc. Natl. Acad. Sci. USA 89:4457-4461 (1992). Techniques for the generation and use of antibody phage libraries are also described in: U.S. Pat. Nos. 5,545,807, 5,969,108, 6,172,197, 5,885,793, 6,521,404, 6,544,731, 6,555,313, 6,582,915, 6,593,081, 6,300,064, 6,653,068, 6,706,484, and 7,264,963; and Rothe et al., J. Mol. Bio. 130:448-54 (2007) (each of which is herein incorporated by reference in its entirety). Affinity maturation strategies and chain shuffling strategies (Marks et al., Bio/Technology 10:779-783 (1992) (which is herein incorporated by reference in its entirety) are known in the art and can be employed to generate high affinity human antibodies.

Antibodies can also be made in mice that are transgenic for human immunoglobulin genes or fragments of these genes and that are capable, upon immunization, of producing a broad repertoire of human antibodies in the absence of endogenous immunoglobulin production. This approach is described in: Lonberg, Nat. Biotechnol 23:1117-1125 (2005), Green et al., Nature Genet. 7:13-21 (1994), and Lonberg et al., Nature 368:856-859 (1994); U.S. Pat. Nos. 5,545,807, 5,545,806, 5,569,825, 5,625,126, 5,633,425, 5,661,016, 6,596,541, 7,105,348, and 7,368,334 (each of which is herein incorporated by reference in its entirety).

IV. Linkers

Multivalent and multispecific compositions (e.g., MRD-containing antibodies) of the invention can contain a single linker, multiple linkers, or no linker. Thus, a MRD may be operably attached (linked) to the antibody directly, or operably attached through an optional linker peptide. Similarly, a MRD may be operably attached to one or more MRD(s) directly, or operably attached to one or more MRD(s) through one or more optional linker peptide(s). Linkers can be of any size or composition so long as they are able to operably attach an MRD and an antibody such that the MRD enables the MRD containing antibody to bind the MRD target.

In some embodiments, linkers have about 1 to 20 amino acids, about 1 to 15 amino acids, about 1 to 10 amino acids, about 1 to 5 amino acids, about 2 to 20 amino acids, about 2 to 15 amino acids, about 2 to 10 amino acids, or about 2 to 5 amino acids. The linker can also have about 4 to 15 amino acids. In certain embodiments, the linker peptide contains a short linker peptide with the sequence GGGS (SEQ ID NO:1), a medium linker peptide with the sequence SSGGGGSGGGGGSS (SEQ ID NO:2), or a long linker peptide with the sequence SSGGGG SGGGGGGSSRSS (SEQ ID NO:19). In another embodiment, the MRD is inserted into the fourth loop in the light chain constant region. For example, the MRD can be inserted between the underlined letters in the following amino acid sequence: RTVAAPSVFIFP PSDEQLKSGTASVVCLLNNFY-PREAKVQWKVDK<u>LG</u>TNSQESVTEQDSKDSTYSL SS TLTLSKADYEKHKVYACEVTHQGLSLPVTKSFN-RGEC (SEQ ID NO:102).

The linker can also be a non-peptide linker such as an alkyl linker, or a PEG linker. For example, alkyl linkers such as —NH—(CH$_2$)s-C(O)—, wherein s=2-20 can be used. These alkyl linkers may further be substituted by any non-sterically hindering group such as lower alkyl (e.g., C$_1$-C$_6$) lower acyl, halogen (e.g., Cl, Br), CN, NH$_2$, phenyl, etc. An exemplary non-peptide linker is a PEG linker. In certain embodiments, the PEG linker has a molecular weight of about 100 to 5000 kDa, or about 100 to 500 kDa.

In some embodiments, the linker is a "cleavable linker" facilitating release of an MRD or cytotoxic agent in the cell. For example, an acid-labile linker (e.g., hydrazone), protease-sensitive (e.g., peptidase-sensitive) linker, photolabile linker, dimethyl linker or disulfide-containing linker (Chari et al., Cancer Research 52:127-131 (1992); U.S. Pat. No. 5,208,020; U.S. Appl. Pub. No. 20090110753) can be used wherein it is desirable that the covalent attachment between an MRD or a cytoxic agent and the multivalent and monovalent multispecific composition (e.g., MRD-containing antibody) is intracellularly cleaved when the composition is internalized into the cell. The terms "intracellularly cleaved" and "intracellular cleavage" refer to a metabolic process or reaction inside a cell on an antibody-drug conjugate (ADC) whereby the covalent attachment, i.e., linked via a linker between the MRD and cytotoxic agent, MRD and antibody, antibody and cytotoxic agent, or between two MRDs is broken, resulting in the free MRD and/or cytotoxic agent dissociated from the antibody inside the cell. The cleaved moieties of the zybody-ADC are thus intracellular metabolites.

Linker optimization can be evaluated using the techniques described in Examples 1-18 and techniques otherwise known in the art. Linkers preferably should not disrupt the ability of an MRD and/or an antibody to bind target molecules.

V. Antibodies Containing MRDs

Using the methods described herein, multi-specificity and greater multi-valency can be achieved through the fusion of MRDs to antibodies.

The MRDs of the multivalent and multispecific compositions (e.g., MRD-containing antibodies) prepared according to the present invention, may be operably linked to an antibody through the peptide's N-terminus or C-terminus. The MRD may be operably linked to the antibody at the C-terminal end of the heavy chain of the antibody, the N-terminal end of the heavy chain of the antibody, the C-terminal end of the light chain of the antibody, or the N-terminal end of the light chain of the antibody. Optimization of the MRD composition, MRD-antibody attachment location and linker composition can be performed using the binding assays described in Examples 1-18 and bioassays and other assays known in the art for the appropriate target related biological activity.

In one embodiment, an MRD-containing antibody is an MRD-containing antibody described in U.S. Application No. 61/489,249, filed May 24, 2011, which is herein incorporated by reference in its entirety.

In one embodiment, multivalent and multispecific compositions (e.g., MRD-containing antibodies) contain an MRD operably linked to either the antibody heavy chain, the antibody light chain, or both the heavy and the light chain. In one embodiment, an MRD-containing antibody contains at least one MRD linked to one of the antibody chain terminals. In another embodiment, an MRD-containing antibody of the invention contains at least one MRD operably linked to two of the antibody chain terminals. In another embodiment, an MRD-containing antibody contains at least one MRD operably linked to three of the antibody chain terminals. In another embodiment, an MRD-containing antibody contains at least one MRD operably attached to each of the four antibody chain terminals (i.e., the N and C terminals of the light chain and the N and C terminals of the heavy chain).

In certain specific embodiments, the MRD-containing antibody has at least one MRD operably attached to the N-terminus of the light chain. In another specific embodiment, the MRD-containing antibody has at least one MRD operably attached to the N-terminus of the heavy chain. In another specific embodiment, the MRD-containing antibody has at least one MRD operably attached to the C-terminus of the light chain. In another specific embodiment, the MRD-containing antibody has at least one MRD operably attached to the C-terminus of the heavy chain.

An MRD-containing antibody can be "multispecific" (e.g., bispecific, trispecific tetraspecific, pentaspecific or of greater multispecificity), meaning that it recognizes and binds to two or more different epitopes present on one or more different antigens (e.g., proteins). Thus, whether an MRD-containing antibody is "monospecific" or "multispecific," (e.g., bispecific, trispecific, and tetraspecific) refers to the number of different epitopes that the MRD-containing antibody binds. Multispecific antibodies may be specific for different epitopes of a target polypeptide (e.g., as described herein) or may be specific for a target polypeptide as well as for a heterologous epitope, such as a heterologous polypeptide target or solid support material. The present invention contemplates the preparation of mono-, bi-, tri-, tetra-, and penta-specific antibodies as well as antibodies of greater multispecificity. In one embodiment, the MRD-containing antibody binds two different epitopes. In an additional embodiment the MRD-containing antibody binds two different epitopes simultaneously. In another embodiment, the MRD-containing antibody binds three different epitopes. In an additional embodiment the MRD-containing antibody binds three different epitopes simultaneously. In another embodiment, the MRD-containing antibody binds four different epitopes. In an additional embodiment the MRD-containing antibody binds four different epitopes simultaneously. In another embodiment, the MRD-containing antibody binds five different epitopes (see, e.g., FIG. 2D). In an additional embodiment the MRD-containing antibody binds five different epitopes simultaneously.

In other embodiments two MRDs of the MRD-containing antibody bind the same antigen. In other embodiments three, four, five, six, seven, eight, nine or ten MRDs of the MRD-containing antibody bind the same antigen. In other embodiments at least two MRDs of the MRD-containing antibody bind the same antigen. In other embodiments at least three, four, five, six, seven, eight, nine or ten MRDs of the MRD-containing antibody bind the same antigen. In other embodiments two MRDs of the MRD-containing antibody bind the same epitope. In other embodiments three, four, five, six, seven, eight, nine or ten MRDs of the MRD-containing antibody bind the same epitope. In other embodiments at least two MRDs of the MRD-containing antibody bind the same epitope. In other embodiments at least three, four, five, six, seven, eight, nine or ten MRDs of the MRD-containing antibody bind the same epitope.

In other embodiments, the antibody and one MRD of the MRD-containing antibody bind the same antigen. In other embodiments the antibody and two, three, four, five, six, seven, eight, nine or ten MRDs of the MRD-containing antibody bind the same antigen. In other embodiments, the antibody and at least one MRD of the MRD-containing antibody bind the same antigen. In other embodiments the antibody and at least two, three, four, five, six, seven, eight, nine or ten MRDs of the MRD-containing antibody bind the same antigen. In other embodiments, the antibody and one MRD of the MRD-containing antibody bind the same epitope. In other embodiments the antibody and two, three, four, five, six, seven, eight, nine or ten MRDs of the MRD-containing antibody bind the same epitope. In other embodiments, the antibody and at least one MRD of the MRD-containing antibody bind the same epitope. In other embodiments the antibody and at least two, three, four, five, six, seven, eight, nine or ten MRDs of the MRD-containing antibody bind the same epitope.

The present invention also provides for two or more MRDs which are linked to any terminal end of the antibody. Thus, in one non-exclusive embodiment, two, three, four, or more MRDs are operably linked to the N-terminal of the heavy chain. In another non-exclusive embodiment, two, three, four, or more MRDs are operably linked to the N-terminal of the light chain. In another non-exclusive embodiment, two, three, four, or more MRDs are operably linked to the C-terminal of the heavy chain. In another non-exclusive embodiment, two, three, four, or more MRDs are operably linked to the C-terminal of the light chain. It is envisioned that these MRDs can be the same or different. In addition, any combination of MRD number and linkages can be used. For example, two MRDs can be operably linked to the N-terminal of the heavy chain of an antibody which contains one MRD linked to the C-terminal of the light chain. Similarly, three MRDs can be operably linked to the C-terminal of the light chain and two MRDs can be operably linked to the N-terminal of the light chain.

Multivalent and multispecific compositions (e.g., MRD-containing antibodies) can contain one, two, three, four, five, six, seven, eight, nine, ten or more than ten MRDs.

Figure 1:
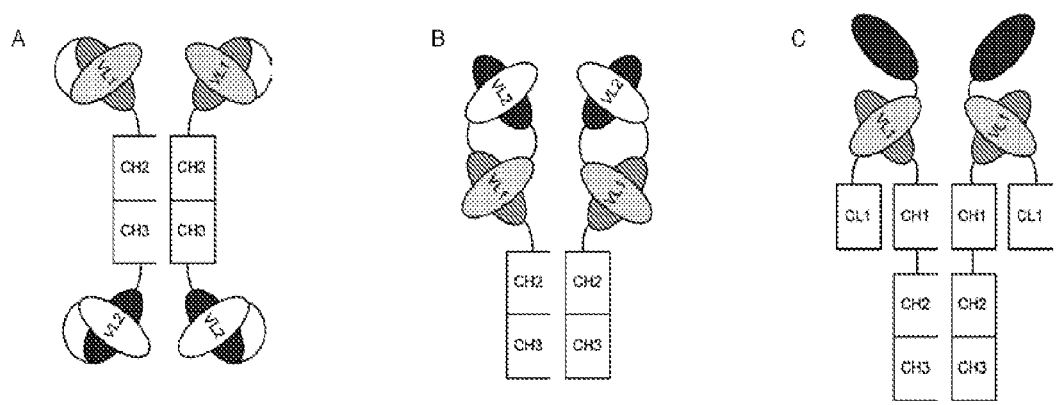
FIG. 1 shows the schematic representation of different designs of multi-specific and multivalent molecules. MRDs are depicted as triangles, circles, diamonds, and squares.
Figure 2:
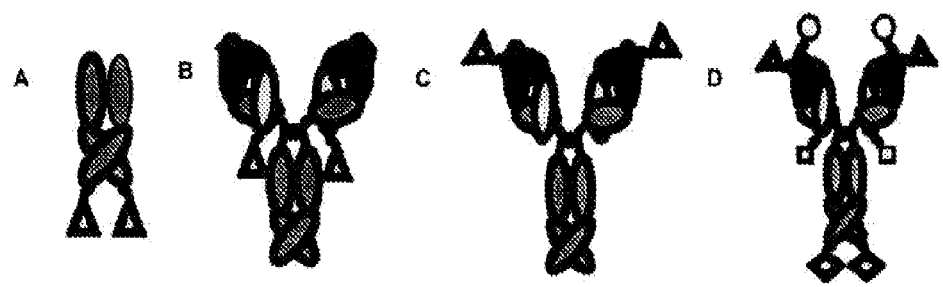
FIG. 2A shows a typical peptibody as a C-terminal fusion with the heavy chain of Fc.
FIG. 2B shows an MRD containing antibody with a C-terminal MRD fusion with the light chain of the antibody.
FIG. 2C shows an MRD containing antibody with an N-terminal MRD fusion with the light chain of the antibody.
FIG. 2D shows an MRD containing antibody with unique MRD peptides fused to each terminus of the antibody.

In one embodiment, the multivalent and monovalent multispecific composition (e.g., MRD-containing antibody) contains one MRD (see, e.g., FIGS. 2B and 2C). In another embodiment, the multivalent and monovalent multispecific composition (e.g., MRD-containing antibody) contains two MRDs. In another embodiment, the multivalent and monovalent multispecific composition (e.g., MRD-containing antibody) contains three MRDs. In another embodiment, the multivalent and monovalent multispecific composition (e.g., MRD-containing antibody) contains four MRDs (see, e.g., FIGS. 2B and 2C). In another embodiment, the multivalent and monovalent multispecific composition (e.g., MRD-containing antibody) contains five MRDs. In another embodiment, the multivalent and monovalent multispecific composition (e.g., MRD-containing antibody) contains six MRDs. In an additional embodiment, the multivalent and monovalent multispecific composition (e.g., MRD-containing antibody) contains between two and ten MRDs.

In one embodiment, the multivalent and monovalent multispecific composition (e.g., MRD-containing antibody) contains at least one MRD. In another embodiment, the multivalent and monovalent multispecific composition (e.g., MRD-containing antibody) contains at least two MRDs. In another embodiment, the multivalent and monovalent multispecific composition (e.g., MRD-containing antibody) contains at least three MRDs. In another embodiment, the multivalent and monovalent multispecific composition (e.g., MRD-containing antibody) contains at least four MRDs. In another embodiment, the multivalent and monovalent multispecific composition (e.g., MRD-containing antibody) contains at least five MRDs. In another embodiment, the multivalent and monovalent multispecific composition (e.g., MRD-containing antibody) contains at least six MRDs.

In another embodiment, the multivalent and monovalent multispecific composition (e.g., MRD-containing antibody) contains two different MRDs. In another embodiment, the multivalent and monovalent multispecific composition (e.g., MRD-containing antibody) contains three different MRDs. In another embodiment, the multivalent and monovalent multispecific composition (e.g., MRD-containing antibody) contains four different MRDs. In another embodiment, the multivalent and monovalent multispecific composition (e.g., MRD-containing antibody) contains five different MRDs. In another embodiment, the multivalent and monovalent multispecific composition (e.g., MRD-containing antibody) contains six different MRDs. In an additional embodiment, the multivalent and monovalent multispecific composition (e.g., MRD-containing antibody) contains between two and ten different MRDs.

In another embodiment, the multivalent and monovalent multispecific composition (e.g., MRD-containing antibody) contains at least two different MRDs. In another embodiment, the multivalent and monovalent multispecific composition (e.g., MRD-containing antibody) contains at least three different MRDs. In another embodiment, the multivalent and monovalent multispecific composition (e.g., MRD-containing antibody) contains at least four different MRDs.

In another embodiment, the multivalent and monovalent multispecific composition (e.g., MRD-containing antibody) contains at least five different MRDs. In another embodiment, the multivalent and monovalent multispecific composition (e.g., MRD-containing antibody) contains at least six different MRDs.

Thus, the multivalent and multispecific compositions (e.g., MRD-containing antibodies) can be MRD monomeric (i.e., containing one MRD at the terminus of a peptide chain optionally connected by a linker) or MRD multimeric (i.e., containing more than one MRD in tandem optionally connected by a linker). The multimeric multivalent and multispecific compositions (e.g., MRD-containing antibodies) can be homo-multimeric (i.e., containing more than one of the same MRD in tandem optionally connected by linker(s) (e.g., homodimers, homotrimers, homotetramers etc.)) or hetero-multimeric (i.e., containing two or more MRDs in which there are at least two different MRDs optionally connected by linker(s) where all or some of the MRDs linked to a particular terminus are different (e.g., heterodimer, heterotrimer, heterotetramer etc.)). In one embodiment, the multivalent and monovalent multispecific composition (e.g., MRD-containing antibody) contains two different monomeric MRDs located at different immunoglobulin termini. In another embodiment, the multivalent and monovalent multispecific composition (e.g., MRD-containing antibody) contains three different monomeric MRDs located at different immunoglobulin termini. In another embodiment, the multivalent and monovalent multispecific composition (e.g., MRD-containing antibody) contains four different monomeric MRDs located at different immunoglobulin termini. In another embodiment, the multivalent and monovalent multispecific composition (e.g., MRD-containing antibody) contains five different monomeric MRDs located at different immunoglobulin termini. In another embodiment, the multivalent and monovalent multispecific composition (e.g., MRD-containing antibody) contains six different monomeric MRDs located at different immunoglobulin termini.

In an alternative embodiment, the multivalent and monovalent multispecific composition (e.g., MRD-containing antibody) contains at least one dimeric and one monomeric MRD located at different immunoglobulin termini. In another alternative embodiment, the multivalent and monovalent multispecific composition (e.g., MRD-containing antibody) contains at least one homodimeric and one monomeric MRD located at different immunoglobulin termini. In another alternative embodiment, the multivalent and monovalent multispecific composition (e.g., MRD-containing antibody) contains at least one heterodimeric and one monomeric MRD located at different immunoglobulin termini.

In an alternative embodiment, the multivalent and monovalent multispecific composition (e.g., MRD-containing antibody) contains at least one multimeric and one monomeric MRD located at different immunoglobulin termini. In another alternative embodiment, the multivalent and monovalent multispecific composition (e.g., MRD-containing antibody) contains at least one homomultimeric and one monomeric MRD located at different immunoglobulin termini. In another alternative embodiment, the multivalent and monovalent multispecific composition (e.g., MRD-containing antibody) contains at least one heteromultimeric and one monomeric MRD located at different immunoglobulin termini.

In an alternative embodiment, the multivalent and monovalent multispecific composition (e.g., MRD-containing antibody) contains MRDs operably linked to at least two different immunoglobulin termini. In a specific embodiment, the MRDs fused to at least one of the immunoglobulins are a multimer. In one embodiment, the MRDs fused to a least one of the immunoglobulins are a homomultimeric (i.e., more than one of the same MRD operably linked in tandem, optionally linked via a linker). In another embodiment, the MRDs fused to at least one of the immunoglobulins are a heteromultimeric (i.e., two or more different MRDs operably linked in tandem, optionally linked via a linker). In an additional embodiment, the MRDs fused to at least one of the immunoglobulins are a dimer. In another embodiment, the MRDs fused to a least one of the immunoglobulins are a homodimer. In another embodiment, the MRDs fused to at least one of the immunoglobulins are a heterodimer.

The multiple MRDs can target the same target binding site, or two or more different target binding sites. Where the MRDs bind to different target binding sites, the binding sites may be on the same or different target molecules.

Similarly, the antibody and the MRD in a multivalent and monovalent multispecific composition (e.g., MRD-containing antibody) may bind to the same target molecule or to different target molecules.

In some embodiments, at least one MRD and the antibody in the multivalent and monovalent multispecific composition (e.g., MRD-containing antibody) can bind to their targets simultaneously. In one embodiment, each MRD in the multivalent and monovalent multispecific composition (e.g., MRD-containing antibody) and the antibody can bind to its target simultaneously. Therefore, in some embodiments, the multivalent and monovalent multispecific composition (e.g., MRD-containing antibody) binds two, three, four, five, six, seven, eight, nine, ten or more targets simultaneously.

The ability of a multivalent and monovalent multispecific composition (e.g., MRD-containing antibody) to bind to multiple targets simultaneously can be assayed using methods known in the art, including, for example, those methods described in the examples below.

Multivalent and Multispecific Compositions Having Monovalent Specificity

In additional embodiments, the multivalent and multispecific compositions (e.g., MRD-containing antibodies) of the invention have a single binding site for (i.e., monovalently bind) a target.

In some embodiments, the antigen binding domains of an antibody component of a multivalent and monovalent multispecific composition of the invention binds to different target epitopes (i.e., the antibody is bispecific). The term "bispecific antibody" is intended to include any antibody, which has two different binding specificities, i.e. the antibody binds two different epitopes, which may be located on the same target antigen or, more commonly, on different target antigens. Methods for making bispecific antibodies are known in the art. (See, for example, Millstein et al., Nature, 305:537-539 (1983); Traunecker et al., EMBO J. 10:3655-3659 (1991); Suresh et al., Methods in Enzymology 121:210 (1986); Kostelny et al., J. Immunol. 148(5): 1547-1553 (1992); Hollinger et al., Proc. Natl. Acad. Sci. USA 90:6444-6448 (1993); Gruber et al., J. Immunol. 152:5368 (1994); Tutt et al., J. Immunol. 147:60-69 (1991); U.S. Pat. Nos. 4,474,893, 4,676,980, 4,714,681, 4,925,648, 5,573,920, 5,601,819, 5,731,168, 5,807,706, and 5,821,333; Intl. Appl. Publ. Nos. WO94/04690, WO91/00360, WO92/05793, WO92/08802, WO92/200373, WO93/17715, WO00/44788, and WO02/096948; EP 1870459A1 and EP 03089, the contents of each of which is herein incorporated by reference in its entirety).

One method for generating bispecific antibodies has been termed the "knobs-into-holes" strategy (see, e.g., Intl. Publ. WO2006/028936). The mispairing of Ig heavy chains is reduced in this technology by mutating selected amino acids forming the interface of the CH3 domains in IgG. At positions within the CH3 domain at which the two heavy chains interact directly, an amino acid with a small side chain (hole) is introduced into the sequence of one heavy chain and an amino acid with a large side chain (knob) into the counterpart interacting residue location on the other heavy chain. In some embodiments, compositions of the invention have immunoglobulin chains in which the CH3 domains have been modified by mutating selected amino acids that interact at the interface between two polypeptides so as to preferentially form a bispecific antibody. The bispecific antibodies can be composed of immunoglobulin chains of the same subclass (e.g., IgG1 or IgG3) or different subclasses (e.g., IgG1 and IgG3, or IgG3 and IgG4)

In one embodiment, a bispecific antibody component of a multispecific and multivalent composition (e.g., MRD-containing antibody) comprises a T366W mutation in the "knobs chain" and T366S, L368A, Y407V mutations in the "hole chain," and optionally an additional interchain disulfide bridge between the CH3 domains by, e.g., introducing a Y349C mutation into the "knobs chain" and a E356C mutation or a S354C mutation into the "hole chain;" R409D, K370E mutations in the "knobs chain" and D399K, E357K mutations in the "hole chain;" R409D, K370E mutations in the "knobs chain" and D399K, E357K mutations in the "hole chain;" a T366W mutation in the "knobs chain" and T366S, L368A, Y407V mutations in the "hole chain;" R409D, K370E mutations in the "knobs chain" and D399K, E357K mutations in the "hole chain;" Y349C, T366W mutations in one of the chains and E356C, T366S, L368A, Y407V mutations in the counterpart chain; Y349C, T366W mutations in one chain and S354C, T366S, L368A, Y407V mutations in the counterpart chain; Y349C, T366W mutations in one chain and S354C, T366S, L368A, Y407V mutations in the counterpart chain; and Y349C, T366W mutations in one chain and S354C, T366S, L368A, Y407V mutations in the counterpart chain (numbering according to the EU index of Kabat).

In some embodiments, a bispecific antibody component of a composition of the invention (e.g., MRD-containing antibody) is an IgG4 antibody or a modified IgG4 antibody, or contains an IgG4 heavy chain or a modified IgG4 heavy chain. IgG4 antibodies are dynamic molecules that undergo Fab arm exchange by swapping an IgG4 heavy chain and attached light chain for a heavy-light chain pair from another IgG4 molecule, thus resulting in bispecific antibodies. Accordingly, Fab arm exchange by swapping of MRD-containing-IgG4 antibodies whether caused in vivo or in vitro under physiologic conditions will lead to bispecific antibody compositions. In particular embodiments, an IgG4 heavy chain of a composition of the invention contains an S228P substitution. This substitution has been shown to significantly inhibit Fab arm exchange in the resulting mutant IgG4 antibodies, and to thereby reduce the likelihood of Fab-arm-exchange between a recombinant antibodies and endogenous IgG4. (See, e.g., Labrijn et al., Nat. Biotechnol. 27(8):767-71 (2009)). In additional embodiments, an IgG4 heavy chain of a composition of the invention contains a substitution of the Arg at position 409 (e.g., with Lys, Ala, Thr, Met or Leu), the Phe at position 405 (e.g., with Lys, Ala, Thr, Met or Leu) or the Lys at position 370. In other embodiments, the CH3 region of an IgG4 heavy chain of a composition of the invention has been replaced with the CHH3 region of IgG1, IgG2 or IgG3. In additional embodiments, interactions between one or more MRDs located at the C-termini of distinct heavy chains (e.g., IgG4 or IgG4 and IgG3) favor and/or stabilize heterodimers between the heavy chains, or otherwise reduces Fab arm exchange by the heterodimer.

Exemplary bispecific antibody components of multivalent and multispecific compositions of the invention include, IgG4 and IgG1, IgG4 and IgG2, IgG4 and IgG2, IgG4 and IgG3, IgG1 and IgG3 chain heterodimers. Such heterodimeric heavy chain antibodies, can routinely be engineered by, for example, modifying selected amino acids forming the interface of the CH3 domains in human IgG4 and the IgG1 or IgG3 so as to favor heterodimeric heavy chain formation. In additional embodiments, interactions between one or more MRDs located at the C-termini of heteromeric heavy chains favors or stabilizes heteromultimeric formation or structure, respectively.

IgG4 antibodies are known to have decreased ADCC activity and half-life compared to other immunoglobulins subclasses such as, IgG1 and IgG3. Accordingly, IgG4 subclass-based formats provide an attractive format for developing therapeutics that bind to and block cell receptors, but do not deplete the target cell. Alternatively, in those embodiments for which increased effector activity is desired, an IgG4 heavy chain of a composition of the invention can be modified as described herein or otherwise known in the art, so as to increase effector function (e.g., modification of the residues at positions 327, 330 and 331; numbering according to EU index of Kabat). Similarly, where increased half-life is desired, an IgG4 heavy chain of a composition of the invention can be engineered as described herein, or otherwise known in the art to more selectively bind the FcRn at pH 6.0, but not pH 7.4, by for example, incorporating mutations located at the interface between the CH2 and CH3 domains, such as substitutions at T250Q/M428L as well as M252Y/S254T/T256E and H433K/N434F (numbering according to the EU index of Kabat).

As exemplified above, it is envisioned that in some embodiments, the multivalent and multispecific compositions (e.g., MRD-containing antibodies) of the invention have a single binding site for (i.e., monovalently bind) a target. In some embodiments, the single binding site (i.e., monovalent binding site) is an antibody antigen binding domain. In other embodiments, the single binding site is an MRD. Thus, the multivalent and multispecific compositions of the invention encompass (and can be routinely engineered to include) MRD-containing antibodies that that contain 1, 2, 3, 4 or more single binding sites for a target. The single binding site(s) may be provided by one or more MRDs located at any one or more of the 4 immunoglobulin heavy chain termini or 4 immunoglobulin light chain termini. Moreover, single binding site may be provided by one of the antigen binding domains of the antibody (wherein an MRD of the MRD-containing antibody binds the same target epitope of the other antigen binding domain of the antibody. Moreover, in a specific embodiment, the compositions of the invention encompass (and can be routinely engineered to include) MRD-containing antibodies that contain 1, 2, 3, 4 or more single binding sites for a target and do not bivalently bind another target In further embodiments, the multivalent and monovalent multispecific composition (e.g., MRD-containing antibodies) has a single binding site for (i.e., monovalently binds) a cell surface target that forms multimers (e.g., homomers or heteromers). In some embodiments, the single binding site binds a cell surface target that requires multimerization for signaling. In some embodiments, the multivalent and monovalent multispecific composition (e.g., an MRD-containing antibody) has a single binding site that binds a cell surface target and inhibits binding of another molecule (such as a ligand) to the cell surface target. In other embodiments, binding of the single binding site inhibits multimerization of the target (e.g., homomeric and heteromeric multimerization). In additional embodiments, the composition has single binding sites for different targets (i.e., monovalently binds more than one different target). In some embodiments, the multiple single binding sites of the composition bind targets on the same cell. In additional embodiments, the multiple single binding sites of the composition bind targets on different cells. Numerous receptors are known in the art that require multimerization for affecting their normal function. Such receptors are envisioned to be targets of single binding sites in the multivalent and multispecific compositions (e.g., MRD-containing antibodies) of the invention. In some embodiments, the composition has a single binding site for a receptor tyrosine kinase. In some embodiments, the composition has a single binding site for a growth factor receptor. In additional embodiments the composition has a single binding site for a G protein coupled receptor. In additional embodiments the composition has a single binding site for a chemokine receptor. In other embodiments, the composition has a single binding site for a TNF receptor superfamily member. In particular embodiments, the composition has a single binding site for a receptor selected from: RAGE, c-Met, ErbB2, VEGFR1, VEGFR2, VEGFR3, FGFR1 (e.g., FGFR1-IIIC), FGFR2 (e.g., FGFR2-IIIa, FGFR2-IIIb, and FGFR2-IIIc), FGFR3, PDGFRA, PDGFRB, netrin, CD28, TNFRSF1A (TNFR1, p55, p60), TNFRSF1B (TNFR2), TNFSF6 (Fas Ligand), TNFRSF6 (Fas, CD95), TNFRSF21 or TNFRSF25, TNFRSF7 (CD27), TNFSF8 (CD30 Ligand), TNFRSF8 (CD30), TNFSF11 (RANKL), TNFRSF11A (RANK), TNFRSF21 (DR6), TNFRSF25 (DR3), and LRP6.

In additional embodiments, the multivalent and monovalent multispecific composition (e.g., an MRD-containing antibody) has a single binding site for (i.e., monovalently binds) a cell surface target that forms a multimer and multiple sites (i.e., multivalently binds) for two or more different targets. In other embodiments, the multivalent and monovalent multispecific composition has a single binding site for a cell surface target and multiple binding sites for 1, 2, 3, 4, 5 or more different targets. In further embodiments, at least 1, 2, 3, 4, 5 or more of the targets bound by the multivalent and monovalent multispecific composition are located on a cell surface. In other embodiments, at least 1, 2, 3, 4, 5 or more of the targets bound by the multivalent and monovalent multispecific composition are soluble targets (e.g., chemokines, cytokines, and growth factors). In additional embodiments, the composition binds 1, 2, 3, 4, 5 or more of the targets described herein. In further embodiments, the targets bound by the composition are tumor antigens (including tumor antigens and tumor associated antigens). In additional embodiments, a target bound by the composition is associated with a disease or disorder of the immune system. In further embodiments, a targets bound by the composition is associated with a disease or disorder of the skeletal system (e.g., osteoporosis), cardiovascular system, nervous system, or an infectious disease.

In some embodiments, an MRD-containing antibody has a single binding site for TNFRSF21 (DR6). In further embodiments, the MRD-containing antibody has a single binding site for DR6 and binds a target selected from: AGE (S100A, amphoterin), IL1, IL6, IL18, IL12, IL23, TNFSF12 (TWEAK), TNF alpha, VEGF, TNFRSF5 (CD40), TNFSF5 (CD40 LIGAND), interferon gamma, GMCSF, an FGF, CXCL13, MCP 1, CCR2, NogoA, RGM A, OMgp MAG, a CPSG, LINGO, alpha-synuclein, a semaphorin (e.g., Semaphorin 3A, Semaphorin 4), an ephrin, VLA4, CD45, RB, C5, CD52 and CD200. Multivalent and multispecific compositions (e.g., MRD-containing antibodies) that bind DR6 and also bind at least 1, 2, 3, 4, 5 or more of these targets are also encompassed by the invention. These compositions have applications in treating diseases and disorders including neurological diseases and disorders such as multiple sclerosis and other neurodegenerative diseases. In specific embodiments, the antibody component of the MRD-containing antibody binds DR6.

In some embodiments, an MRD-containing antibody has a single binding site for TNFRSF25 (DR3). In further embodiments, the MRD-containing antibody has a single binding site for DR3 and binds a target selected from: TNF, IFN alpha, IFN gamma, IL1, IL1beta, IL6, IL8, IL12, IL15, IL17, IL18, IL23 and IL32. Multivalent and multispecific compositions (e.g., MRD-containing antibodies) that bind DR3 and also bind at least 1, 2, 3, 4, 5 or more of these targets are also encompassed by the invention. These compositions have applications in treating diseases and disorders including inflammatory bowel disease and autoimmune diseases such as rheumatoid arthritis. In specific embodiments, the antibody component of the MRD-containing antibody binds DR3.

In further embodiments, the multivalent and monovalent multispecific composition (e.g., MRD-containing antibodies) has multiple binding site for (i.e., multivalently binds) a cell surface target that forms multimers (e.g., homomers or heteromers). In some embodiments, the multiple binding sites bind a cell surface target that requires multimerization for signaling. In some embodiments, the multivalent and monovalent multispecific composition (e.g., an MRD-containing antibody) has multiple binding sites for a cell surface target. In further embodiments, binding of the multiple binding sites result in multimerization of the target (e.g., homomeric and heteromeric multimerization). In additional embodiments, the composition has multiple binding sites for different targets (i.e., multivalently binds more than one different target). In some embodiments, the multiple single binding sites of the composition bind targets on the same cell. In additional embodiments, the multiple single binding sites of the composition bind targets on different cells. Numerous receptors are known in the art that require multimerization for affecting their normal function. Such receptors are envisioned to be targets of the multivalent and multispecific compositions (e.g., MRD-containing antibodies). In some embodiments, the composition has multiple binding sites for a receptor tyrosine kinase. In some embodiments, the composition has a multiple binding site for a growth factor receptor. In additional embodiments the composition has multiple binding sites for a G protein coupled receptor. In additional embodiments the composition has multiple binding sites for a chemokine receptor. In other embodiments, the composition has multiple binding sites for a TNF receptor superfamily member.

In some embodiments, an MRD-containing antibody binds TNFRSF10A (DR4). In further embodiments, the MRD-containing antibody binds DR4 and a target selected from: ErbB2, EGFR, IGF1R, TNFRSF10b (DR5), CD19, CD20, CD22, CD30, CD33, TNFRSF5 (CD40), TNFRSF9 (41BB), IL6, and IGF1,2. Multivalent and multispecific compositions (e.g., MRD-containing antibodies) that bind DR4 and also bind at least 2, 3, 4, 5 or more of these targets are also encompassed by the invention. These compositions have applications in treating diseases and disorders including cancers such as breast cancer, colorectal cancer, head and neck cancer, B-cell lymphomas, hairy cell leukemia, B-cell chronic lymphocytic leukemia and melanoma. In specific embodiments, the antibody component of the MRD-containing antibody binds DR4. In further embodiments, the antibody component of the MRD-containing antibody is CS1008 or mapatumumab.

In some embodiments, an MRD-containing antibody binds TNFRSF10B (DR5). In some embodiments, an MRD-containing antibody binds DR5 and a target selected from: ErbB2, EGFR, IGF1R, TNFRSF10A (DR4), CD19, CD20, CD22, CD25, CD30, CD33, CD138, syndecan, CD39, TNFRSF5 (CD40), TNFRSF9 (41BB), IL6, and IGF1,2. Multivalent and multispecific compositions (e.g., MRD-containing antibodies) that bind DR5 and also bind at least 2, 3, 4, 5 or more of these targets are also encompassed by the invention. These compositions have applications in treating diseases and disorders including cancers such as breast cancer, colorectal cancer, head and neck cancer, B-cell lymphomas, hairy cell leukemia, B-cell chronic lymphocytic leukemia, and melanoma. In specific embodiments, the antibody component of the MRD-containing antibody binds DR5. In further embodiments, the antibody component of the MRD-containing antibody is LBY135, AMG66, Apomab, PRO95780, lexatumumab, conatumumab or tigatuzumab.

Compositions that Redirect Effector Cell Function

The invention also encompasses multivalent and multispecific compositions such as, multivalent and multispecific compositions (e.g., MRD-containing antibodies) that are capable of juxtaposing host effector cells with cells that are desired to be eliminated (e.g., immune cells, cancer cells, diseased cells, infectious agents, and cells infected with infectious agents). The multivalent and multispecific functionalities of the compositions of the invention are particularly well suited for redirecting host immune responses and provide numerous advantages over alternative multispecific composition platforms under development. In one embodiment, the multivalent and monovalent multispecific composition (e.g., an MRD-containing antibody) binds (1) a target on a cell, tissue, or infectious agent of interest (e.g., an immune cell or a tumor antigen on a tumor cell) and (2) a target on an effector cell so as to direct an immune response to the cell, tissue, or infectious agent of interest. The target(s) to which the multivalent and monovalent multispecific composition binds can be monomeric or multimeric. Moreover, the mulitimeric target to which a multivalent and monovalent multispecific composition binds can be homomultimeric or heteromultimeric. In additional embodiments, the multivalent and monovalent multispecific composition binds at least 2, 3, 4, or 5 targets on the cell, tissue, or infectious agent of interest. In additional embodiments, one or more targets bound by the multivalent and monovalent multispecific composition is a tumor antigen (e.g., tumor antigens and tumor/cancer associated antigens). The multivalent and multispecific compositions also have applications in treating diseases and disorders including, but not limited to, diseases of the immune system, skeletal system, cardiovascular system, and nervous system, as well as infectious disease. Thus, in some embodiments, 1, 2, 3, 4, 5 or more targets bound by the multivalent and monovalent multispecific composition is associated with a disease or disorder of the immune system (for example, a disease or disorder of the immune system disclosed herein, such as inflammation or an autoimmune disease (e.g., rheumatoid arthritis)). In additional embodiments, 1, 2, 3, 4, 5 or more targets bound by the multivalent and monovalent multispecific composition is associated with a disease or disorder of the skeletal system (e.g., osteoporosis or another disease or disorder of the skeletal system as disclosed herein). In additional embodiments, 1, 2, 3, 4, 5 or more targets bound by the multivalent and monovalent multispecific composition is associated with a disease or disorder of the cardiovascular system (e.g., a disease or disorder of the cardiovascular system disclosed herein). In additional embodiments, 1, 2, 3, 4, 5 or more targets bound by the multivalent and monovalent multispecific composition is associated with a disease or disorder of the nervous system (e.g., a disease or disorder of the nervous system disclosed herein). In additional embodiments, 1, 2, 3, 4, 5 or more targets bound by the multivalent and monovalent multispecific composition is associated with an infectious agent or disease (e.g., an infectious disease or agent disclosed herein).

Effector cells that can be bound by a multivalent and monovalent multispecific composition (e.g., an MRD-containing antibody) of the invention include, but are not limited to, T cells, monocytes/macrophages, and natural killer cells.

In one embodiment, the target on a cell to which a multivalent and monovalent multispecific composition (e.g., an MRD-containing antibody) directs an immune response is a tumor antigen. The multivalent and multispecific compositions of the invention (e.g., MRD-containing antibodies) are envisioned to be capable of binding virtually any type of tumor and any type of tumor antigen. Exemplary types of tumors that can be targeted include, but are not limited to, one or more cancers selected from the group: colorectal cancer, esophageal, gastric, head and neck cancer, thyroid cancer, multiple myeloma, renal cancer, pancreatic cancer, lung cancer, biliary cancer, glioma, melanoma, liver cancer, prostate cancer, and urinary bladder cancer breast cancer, ovarian cancer, cervical cancer, and endometrial cancer. Exemplary types of tumors that may be targeted include hematological cancers. Hematological cancers that may be targeted include, but are not limited to, one or more cancers selected from the group Hodgkin's lymphoma, medullary non-Hodgkin's lymphoma, acute lymphoblastic leukemia, lymphocytic leukemia, and chronic myelogenous leukemia, acute myelogenous leukemia.

Exemplary tumor antigens include ErbB1, ErbB2, ErbB3, VEGFR1, VEGFR2, EGFRvIII, CD16, CD19, CD20, oncostatin M, PSA, PSMA, integrin avb6, ADAM9, CD22, CD23, CD25, CD28, CD36, CD45, CD46, CD56, CD79a/CD79b, CD103, JAM-3, gp100, ALCAM, PIPA, A33, carboxypeptidease M, E-cadherin, CA125, CDK4, CEA, CTLA-4, RAAG10, transferrin receptor, p-15, GD2, MUM-1, MAGE-1, MAGE-3, KSA, MOC31, MIC-1, EphA2, GAGE-1, GAGE-2, MART, KID31, CD44v3, CD44v6, and ROR1. Additional exemplary tumor antigens are described herein and/or known in the art.

In one embodiment, the target on a cell to which a multivalent and monovalent multispecific composition (e.g., an MRD-containing antibody) directs an immune response is an immune cell or an inflammatory cell.

In some embodiments, the invention encompasses a multivalent and monovalent multispecific composition that binds a tumor antigen that is not expressed on tumor cells themselves, but rather on the surrounding reactive and tumor supporting, non-malignant cells comprising the tumor stroma (i.e., tumor associated antigens). The tumor stroma comprises endothelial cells forming new blood vessels and stromal fibroblasts surrounding the tumor vasculature. In one embodiment, a multivalent and monovalent multispecific composition binds a tumor associated antigen on an endothelial cell. In an additional embodiment, a multivalent and monovalent multispecific composition binds a tumor antigen and also binds a tumor associated antigen on a fibroblast cell. In a further embodiment, a multivalent and monovalent multispecific composition binds a tumor antigen and also binds fibroblast activation protein (FAP).

Infectious agents to which a multivalent and monovalent multispecific composition (e.g., an MRD-containing antibody) can direct an immune response include, but are not limited to, prokaryotic and eukaryotic cells, viruses (including bacteriophage), foreign objects (e.g., toxins), and infectious organisms such as funghi, and parasites (e.g., mammalian parasites), as described herein and infectious agents associated with infectious diseases described herein. The term infectious agents is also intended to encompass other prokaryotic and eukaryotic cells, viruses (including bacteriophage), foreign objects (e.g., toxins), and infectious organisms such as funghi, and parasites otherwise known in the art.

In further embodiments, the multivalent and monovalent multispecific composition (e.g., an MRD-containing antibody) binds (1) a target on a cell, tissue, or infectious agent of interest (e.g., a tumor antigen on a tumor cell) and (2) has a single binding site for a target on an effector cell so as to direct an immune response to the cell, tissue, or infectious agent of interest. In some embodiments the single binding site is an MRD. In other embodiments, the single binding site is an antibody antigen binding domain. In further embodiments, binding of the multivalent and monovalent multispecific composition does not elicit a signal when the composition binds a target on an effector cell. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments, 1, 2, 3, 4, 5 or more targets bound by the multivalent and monovalent multispecific composition is a tumor antigen (e.g., tumor antigens and tumor/cancer associated antigens). In additional embodiments, one or more targets bound by the multivalent and monovalent multispecific composition are associated with a disease or disorder of the immune system. In additional embodiments, one or more targets bound by the multivalent and monovalent multispecific composition are associated with a disease or disorder of the skeletal system (e.g., osteoporosis), cardiovascular system, nervous system, or an infectious disease.

In additional embodiments, the multivalent and monovalent multispecific composition (e.g., an MRD-containing antibody) binds (1) a target on a cell, tissue, or infectious agent of interest (e.g., a tumor antigen on a tumor cell) and (2) a target on a leukocyte so as to direct an immune response to the cell, tissue, or infectious agent of interest. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments the multivalent and monovalent multispecific composition binds 1, 2, 3, 4, 5 or more targets described herein. In additional embodiments, 1, 2, 3, 4, 5 or more targets bound by the multivalent and monovalent multispecific composition are a tumor antigen (e.g., tumor antigens and tumor/cancer associated antigens). In additional embodiments, one or more targets bound by the multivalent and monovalent multispecific composition are associated with a disease or disorder of the immune system. In additional embodiments, one or more targets bound by the multivalent and monovalent multispecific composition are associated with a disease or disorder of the skeletal system (e.g., osteoporosis), cardiovascular system, nervous system, or an infectious disease.

The invention also encompasses multivalent and multispecific compositions that bind a target expressed on a leukocyte. In some embodiments, the multivalent and monovalent multispecific composition (e.g., an MRD-containing antibody) binds (1) a target on a cell, tissue, or infectious agent of interest (e.g., a tumor antigen on a tumor cell) and (2) has a single binding site for a target on a leukocyte so as to direct an immune response to the cell, tissue, or infectious agent of interest. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments, 1, 2, 3, 4, 5 or more antigens and tumor/cancer associated antigens). In additional embodiments, 1, 2, 3, 4, 5 or more targets bound by the multivalent and monovalent multispecific composition are associated with a disease or disorder of the immune system. In additional embodiments, 1, 2, 3, 4, 5 or more targets bound by the multivalent and monovalent multispecific composition are associated with a disease or disorder of the skeletal system (e.g., osteoporosis), cardiovascular system, nervous system, or an infectious disease.

In one embodiment, the multivalent and monovalent multispecific composition binds a target expressed on a T cell. In some embodiments, the multivalent and monovalent multispecific composition (e.g., an MRD-containing antibody) binds (1) a target on a cell, tissue, or infectious agent of interest (e.g., a tumor antigen on a tumor cell) and (2) a target on a T cell so as to juxtapose myeloid cells with the cell, tissue, or infectious agent of interest. In some embodiments, the multivalent and monovalent multispecific composition has multiple binding sites for (i.e., multivalently binds) a target on a T cell. In other embodiments, the multivalent and monovalent multispecific composition has a single binding site for (i.e., monovalently binds) a target on a T cell. In some embodiments the single binding site is an MRD. In other embodiments, the single binding site is an antibody antigen binding domain. In further embodiments, binding of the multivalent and monovalent multispecific composition does not elicit a signal when the composition binds a target on a T cell. In other embodiments, the binding of the multivalent and monovalent multispecific composition does not result in lysis of the T cell expressing the target. In some embodiments, the multivalent and monovalent multispecific composition binds a target selected from: CD2, CD3, CD4, CD8, CD161, a chemokine receptor, CD95, and CCR5. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments, 1, 2, 3, 4, 5 or more targets bound by the multivalent and monovalent multispecific composition is a tumor antigen (e.g., tumor antigens and tumor/ cancer associated antigens). In additional embodiments, 1, 2, 3, 4, 5 or more targets bound by the multivalent and monovalent multispecific composition are associated with a disease or disorder of the immune system. In additional embodiments, 1, 2, 3, 4, 5 or more targets bound by the multivalent and monovalent multispecific composition are associated with a disease or disorder of the skeletal system (e.g., osteoporosis), cardiovascular system, nervous system, or an infectious disease.

In further embodiments, the multivalent and monovalent multispecific composition contains a fusion protein containing one or more peptides that bind to a protein on the surface of a cell, such as a T cell. In additional embodiments, the multivalent and monovalent multispecific composition bind target membrane proximal protein sequences on a cell and inhibit the cross-linking (e.g., multimerization) of the target protein or its associated proteins. In a particular embodiment, the multivalent and monovalent multispecific composition binds to a T cell and inhibits the cross-linking of the cell protein or its associated proteins. For example, in one embodiment, the multivalent and multispecific antibody comprises the amino terminal 27 amino acids of mature CD3 epsilon. In another embodiment, the multivalent and monovalent multispecific composition comprises a fusion protein containing one or more proteins corresponding to the G Domain of a CD3 protein (e.g., CD3 epsilon, CD3 gamma, CD3 alpha (TCRA) or CD3 beta (TCRB). Thus, in some embodiments, the fusion protein comprises a polypeptide having an amino acid sequence selected from: GYYVCYPRGSKPEDANFYLYLR ARVC (SEQ ID NO:21), YLYLRAR (SEQ ID NO:22), YRCNGTDIYKDKESTVQ VHYRMC (SEQ ID NO:23), and DKESTVQVH (SEQ ID NO:24). In additional embodiments, the composition comprises a fusion protein containing one or more proteins corresponding to a portion of the extracellular domain of a CD3 protein (e.g., CD3 epsilon, CD3 gamma, CD3 alpha (TCRA) or CD3 beta (TCRB)) that is able to bind CD3, or a CD3 multimer. Thus, in some embodiments, the fusion protein comprises a portion of a CD3 protein that is able to bind CD3 or a CD3 multimer wherein the portion comprises a CD3 binding fragment of a polypeptide having an amino acid sequence selected from: KIPIEELEDRVFVNCNTSITWVEG TVGTLLSDITRLDLGKRILDPRGIYRCNGTDIY KDKESTVQVHYRMCQSCVELD (human CD3 delta mature ECD, SEQ ID NO:25), QSIKGNHLVKVYDYQEDGSVLLTCDAEAK NITWFKDGKMIGFLTEDKKKWNLGSNAKDPRGMYQCKGSQNKSKPLQVYYRM CQNCIELN (human CD3 gamma mature ECD, Ig-like domain highlighted; SEQ ID NO:26), GNEEMGGITQTPYKVSISGTTVILTCPQYPGSEILWQHNDKNIGGDEDDKNIGS DEDHL SLKEFSELEQSGYYVCYPRGSKPEDANFYLYLRARVCENCMEMDVM (human CD3 epsilon mature ECD, Ig-like domain highlighted, SEQ ID NO:27), and QSFGLLDPK (human CD3 zeta mature ECD, SEQ ID NO:28), In alternative embodiments, the fusion protein comprises a chemokine fragment that binds a target on the cell surface. In some embodiments, the chemokine fragment is a portion of a chemokine selected from: CCL20 (LARC/Ckβ4), CCL25 (TECK/Ckβ15), CXCL12 (SDF-1), CXCL13 (BCA-1), CXCL16 (SRPSOX), and CX3CL1 (Fractalkine) In some embodiments, the chemokine fragment is a portion of a chemokine selected from: CCL5 (RANTES), CCL8 (MCP-2), CXCL9 (MIG/CRG-10), CXCL10 (IP-10/CRG-2) and CXCL11 (TAC/IP-9). In some embodiments, the chemokine fragment is a portion of a chemokine selected from CCL3 (MIP-1a) and CCL4 (MIP-113).

In some embodiments, the invention comprises an MRD and/or a multivalent and monovalent multispecific composition (e.g., an MRD-containing antibody) that binds CD3 and contains an amino acid sequence selected from the group consisting of: SEQ ID NO:4329-4492 and 4493, as set forth in Table 22. In another embodiment, the invention encompasses an MRD and/or MRD-containing antibody that competes for CD3 binding with a polypeptide having an amino acid sequence selected from the group consisting of: SEQ ID NO:4329-4492 and 4493. In a further embodiment, the invention encompasses an MRD and/or a multivalent and monovalent multispecific composition (e.g., an MRD-containing antibody) that binds to the same epitope of CD3 as a polypeptide having an amino acid sequence selected from the group consisting of: SEQ ID NO:4329-4492 and 4493.

In particular embodiments, the invention encompasses an MRD and/or a multivalent and monovalent multispecific composition (e.g., an MRD-containing antibody) that binds CD3 and contains an amino acid sequence selected from the group consisting of: IALMCSMHFDEVVWCSPYY (CD31916; SEQ ID NO:4494); PLMLCRHMKHFEYYC WPLA (CD3437; SEQ ID NO:4495); PVICQWTLELQCSPWT (CD3914; SEQ ID NO:4496); ILLECYWEDWRLVCSSLA (CD3434; SEQ ID NO:4497); KGTICWWHLEATCFATS (CD3702; SEQ ID NO:4498); and LREICVKVPYGVVCQRLP (CD31913; SEQ ID NO:4499). In an additional embodiment, the invention encompasses an MRD and/or multivalent and monovalent multispecific composition that competes for CD3 binding with a polypeptide having an amino acid sequence selected from the group consisting of: SEQ ID NO:4494-4498 and 4499. In a further embodiment, the invention encompasses an MRD and/or a multivalent and monovalent multispecific composition (e.g., an MRD-containing antibody) MRD-containing antibody that binds to the same epitope of CD3 as a polypeptide having an amino acid sequence selected from the group consisting of: SEQ ID NO:4494-4498 and 4499.

In particular embodiments, the composition binds a CD3 target selected from CD3 delta, CD3 epsilon, CD3 gamma, CD3 zeta, TCR alpha, TCR beta, the TCR complex, or a heteromeric or homomultimeric combination thereof. In a further embodiment, the composition binds CD3 epsilon. In additional embodiments, the multivalent and monovalent multispecific composition binds CD3 and multiple binding sites for 1, 2, 3, 4, 5 or more different targets (e.g., a tumor antigen as disclosed herein or otherwise known in the art). In additional embodiments, the multivalent and monovalent multispecific composition has a single binding site for (i.e., monovalently binds) CD3. In further embodiments, the multivalent and monovalent multispecific composition has a single MRD that binds CD3 and multiple binding sites for 1, 2, 3, 4, 5 or more different targets (e.g., a tumor antigen as disclosed herein or otherwise known in the art). In further embodiments, the multivalent and monovalent multispecific composition has a single antibody antigen binding domain that binds CD3 and multiple binding sites for 1, 2, 3, 4, 5 or more different targets (e.g., a tumor antigen as disclosed herein or otherwise known in the art). In particular embodiments, the CD3 binding compositions of the invention are not single chain antibodies.

In some embodiments, the multivalent and monovalent multispecific composition (e.g., an MRD-containing antibody) binds human CD3 and a CD3 ortholog from another organism. In additional embodiments, the multivalent and monovalent multispecific composition binds human CD3 and a CD3 ortholog from another primate. In further embodiments, the multivalent and monovalent multispecific composition binds human CD3 and a CD3 ortholog from cynomolgus Monkey or rhesus Monkey. In other embodiments, the multivalent and monovalent multispecific composition binds human CD3 and a CD3 ortholog from a primate selected from Saguinus Oedipus and Callithrix jacchus). In an additional embodiment, the multivalent and monovalent multispecific composition binds human CD3 and a CD3 ortholog from cynomolgus monkey, and a CD3 ortholog from mouse or rat. In particular embodiments, the human CD3 epsilon binding compositions of the invention are not single chain antibodies. In additional particular embodiments, the CD3 binding compositions of the invention are not single chain antibodies.

According to one embodiment, the multivalent and monovalent multispecific composition (e.g., an MRD-containing antibody) binds human CD3 epsilon. In a particular embodiment, the, multivalent and monovalent multispecific composition binds human CD3 epsilon protein having the sequence of amino acids 23-207 set forth in NCBI Ref Seq. No. NP_000724. In another embodiment, the multivalent and monovalent multispecific composition binds a polypeptide having the amino acid sequence of QDGNEEMG-GITQTPYKVSISGTT VILT (SEQ ID NO:29). In an additional embodiment, the multivalent and monovalent multispecific composition binds a polypeptide having the amino acid sequence of QDGNEEMGGI (SEQ ID NO:30). In a further embodiment, the multivalent and monovalent multispecific composition binds a polypeptide having the amino acid sequence of QDGNEEMGG (SEQ ID NO:31). In particular embodiments, the human CD3 epsilon binding compositions of the invention are not single chain antibodies.

In some embodiments, a multivalent and monovalent multispecific composition (e.g., an MRD-containing antibody) has a single binding site for CD3 epsilon (i.e., monovalently binds CD3 epsilon) and multiple binding sites for 1, 2, 3, 4, 5 or more different targets (e.g., a B cell or other target disclosed herein). In further embodiments, the multivalent and monovalent multispecific composition (e.g., an MRD-containing antibody) competes for binding to CD3 with an antibody selected from: OKT-3, otelixizumab, teplizumab, visilizumab, muromonab, X35-3, VIT3, BMA030 (BW264/56), CLB-T3/3, CRIS7, YTH12.5, F111409, CLB-T3.4.2, TR-66, WT31, WT32, SPv-T3b, 11D8, XIII-141, XIII46, XIII-87, 12F6, T3/RW2-8C8, T3/RW24B6, OKT3D, M-T301, SMC2 and F101.01. In additional embodiments, an MRD of an MRD-containing antibody competes for binding to CD3 with an antibody selected from: OKT-3, otelixizumab, teplizumab, visilizumab, muromonab X35-3, VIT3, BMA030 (BW264/56), CLB-T3/3, CRIS7, YTH12.5, F111409, CLB-T3.4.2, TR-66, WT31, WT32, SPv-T3b, 11D8, XIII-141, XIII46, XIII-87, 12F6, T3/RW2-8C8, T3/RW24B6, OKT3D, M-T301, SMC2 and F101.01. In further embodiments, the multivalent and monovalent multispecific composition (e.g., MRD-containing antibody) competes for binding to CD3 with a CD3 binding composition disclosed in Int. Appl. Pub Nos. WO2004/106380 and WO99/54440; Tunnacliffe et al., Int. Immunol. 1:546-550 (1989); Kjer-Nielsen, PNAS 101:7675-7680 (2004); or Salmeron et al., J. Immunol. 147: 3047-3052 (1991).

In additional embodiments, the multivalent and monovalent multispecific composition (e.g., an MRD-containing antibody) binds human CD3 epsilon and a CD3 epsilon ortholog from another organism. In some embodiments, the multivalent and monovalent multispecific composition (e.g., an MRD-containing antibody) binds human CD3 epsilon and a CD3 epsilon ortholog from another primate. In additional embodiments, the multivalent and monovalent multispecific composition binds human CD3 epsilon and a CD3 epsilon ortholog from cynomolgus monkey or rhesus monkey. In additional embodiments, the multivalent and monovalent multispecific composition binds human CD3 epsilon and a CD3 epsilon ortholog from a primate selected from Saguinus Oedipus and Callithrix jacchus. In an additional embodiment, the multivalent and monovalent multispecific composition binds human CD3 epsilon and a CD3 epsilon ortholog from cynomolgus monkey, and a CD3 epsilon ortholog from mouse or rat. In particular embodiments, an MRD of the multivalent and monovalent multispecific composition binds CD3 epsilon.

In another embodiment the multivalent and monovalent multispecific composition (e.g., an MRD-containing antibody) binds human CD3 delta. In a particular embodiment, the, multivalent and monovalent multispecific composition binds human CD3 delta having the sequence of amino acids 22-171 set forth in NCBI Ref. Seq. No. NP_000723. In particular embodiments, an MRD of the multivalent and monovalent multispecific composition binds CD3 delta. In other embodiments, an antibody antigen binding domain of the multivalent and monovalent multispecific composition binds CD3 delta. In particular embodiments, the human CD3 epsilon binding compositions of the invention are not single chain antibodies.

In an additional embodiment, the multivalent and monovalent multispecific composition (e.g., an MRD-containing antibody) binds human CD3 gamma protein having the sequence of amino acids 23-182 set forth in NCBI Ref. Seq. No. NP_000064. In particular embodiments, an MRD of the multivalent and monovalent multispecific composition binds gamma. In particular embodiments, an MRD of the multivalent and monovalent multispecific composition binds CD3 gamma. In other embodiments, an antibody antigen binding domain of the multivalent and monovalent multispecific composition binds CD3 gamma. In particular embodiments, the human CD3 gamma binding compositions of the invention are not single chain antibodies.

In an additional embodiment, the multivalent and monovalent multispecific composition (e.g., an MRD-containing antibody) binds human CD3 zeta protein having the sequence of amino acids 22-164 set forth in NCBI Ref. Seq. No. NP_932170. In particular embodiments, an MRD of the multivalent and monovalent multispecific composition binds CD3 zeta. In other embodiments, an antibody antigen binding domain of the multivalent and monovalent multispecific composition binds CD3 zeta. In particular embodiments, the human CD3 zeta binding compositions of the invention are not single chain antibodies.

The invention also encompasses multivalent and multispecific compositions that bind a target expressed on a natural killer cell. In some embodiments, the multivalent and monovalent multispecific composition (e.g., an MRD-containing antibody) binds (1) a target on a cell, tissue, or infectious agent of interest (e.g., a tumor antigen on a tumor cell) and (2) a target on a natural killer cell. In some embodiments, the multivalent and monovalent multispecific composition has multiple binding sites for (i.e., multivalently binds) a target on a natural killer cell. In other embodiments, the multivalent and monovalent multispecific composition has a single binding site for (i.e., monovalently binds) a target on a natural killer cell. In some embodiments the single binding site is an MRD. In other embodiments, the single binding site is an antibody antigen binding domain. In further embodiments, binding of the multivalent and monovalent multispecific composition does not elicit a signal when the composition binds a target on a natural killer cell. In some embodiments, the multivalent and monovalent multispecific composition binds a target selected from: KLRD1, KLRK1, KLRB1, 2B4 (CD244), KIR2D4, KIR2D5, and KIR3DL1. In other embodiments, the multivalent and monovalent multispecific composition binds a target selected from: CD56, CD2, and CD161. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments, 1, 2, 3, 4, 5 or more targets bound by the multivalent and monovalent multispecific composition are a tumor antigen (e.g., tumor antigens and tumor/cancer associated antigens). In additional embodiments, 1, 2, 3, 4, 5 or more targets bound by the multivalent and monovalent multispecific composition are associated with a disease or disorder of the immune system. In additional embodiments, 1, 2, 3, 4, 5 or more targets bound by the multivalent and monovalent multispecific composition are associated with a disease or disorder of the skeletal system (e.g., osteoporosis), cardiovascular system, nervous system, or an infectious disease.

In a particular embodiment, the invention encompasses an MRD and/or a multivalent and monovalent multispecific composition (e.g., an MRD-containing antibody) that binds NKGD2 and contains an amino acid sequence selected from the group consisting of: FSLFCYNVHGWWECFPVY (NKG1; SEQ ID NO:4500); SLTWCMVEKLHYWVICDRVA (NKG4; SEQ ID NO:4501); ILISCQEQWPVFQCYAVR (NKG7; SEQ ID NO:4502); HEEDCYWILYQHCPRAT (NKG9; SEQ ID NO:4503); LEHLCTTYPMWFHCPEGA (NKG12 SEQ ID NO:4504); SGLVCFSRFDWWECVWTS (NKG14; SEQ ID NO:4505); SLTRSRYQRFHYWVICDRVA (NKG15; SEQ ID NO:4506); and YTVACYYGVDQY WMCFSNS (NKG17; SEQ ID NO:4507). In an additional embodiment, the invention encompasses an MRD and/or multivalent and monovalent multispecific composition that competes for NKGD2 binding with a polypeptide having an amino acid sequence selected from the group consisting of: SEQ ID NO:4500-4506 and 4507. In a further embodiment, the invention encompasses an MRD and/or a multivalent and monovalent multispecific composition (e.g., an MRD-containing antibody) MRD-containing antibody that binds to the same epitope of NKGD2 as a polypeptide having an amino acid sequence selected from the group consisting of: SEQ ID NO:4500-4506 and 4507.

In some embodiments, the invention comprises an MRD and/or a multivalent and monovalent multispecific composition (e.g., an MRD-containing antibody) that binds CD319 (CRACC) and contains an amino acid sequence selected from the group consisting of: WRLDCWEHHEWDFWCWAHG (SEQ ID NO:4508); SLYECWRVFVSFPRCPDGS (SEQ ID NO:4509); LYLLCEHVHDKHWECGSWL (SEQ ID NO:4510); IHLRCTYVEPLYML CSPYA (SEQ ID NO:4511); TMMVECYMGYCYPTVF (SEQ ID NO:4512); VLLRCQYVGV SHIKCKSVD (SEQ ID NO:4513); LVLECFLIDAWYMKCHTTG (SEQ ID NO:4514); LRL YCIPVDHTFFKCTLYG (SEQ ID NO:4515); YCIYRCQVQQCWMFPA (SEQ ID NO:4516); WHIACWEMRDVHWYVCEFFV (SEQ ID NO:4517); RVLQCKWVSSEYFQCVETS (SEQ ID NO:4518); VVVECFQVKEMYWSCRPAV (SEQ ID NO:4519); and YLMYCTALEYPYF QCRQMV (SEQ ID NO:4520). In another embodiment, the invention encompasses an MRD and/or MRD-containing antibody that competes for CRACC binding with a polypeptide having an amino acid sequence selected from the group consisting of: SEQ ID NO:4508-4519 and 4520. In a further embodiment, the invention encompasses an MRD and/or a multivalent and monovalent multispecific composition (e.g., an MRD-containing antibody) that binds to the same epitope of CRACC as a polypeptide having an amino acid sequence selected from the group consisting of: SEQ ID NO:4508-4519 and 4520.

In specific embodiments, the multivalent and monovalent multispecific composition binds CD2. According to one embodiment, the multivalent and monovalent multispecific composition (e.g., an MRD-containing antibody) binds human CD2. In a particular embodiment, the multivalent and monovalent multispecific composition binds human CD2 protein having the sequence of amino acids 25-209 set forth in NCBI Ref. Seq. No. NP_001758. In some embodiments, the multivalent and monovalent multispecific composition has multiple binding sites for CD2. In some embodiments the single binding site is an MRD. In other embodiments, the single binding site is an antibody antigen binding domain. In other embodiments, the multivalent and monovalent multispecific composition has a single binding site for CD2. In further embodiments, binding of the multivalent and monovalent multispecific composition to CD2 does not elicit a signal by the cell on which CD2 is expressed. In additional embodiments, the multivalent and monovalent multispecific composition binds CD2 and 1, 2, 3, 4, 5 or more different targets (e.g., a tumor antigen as disclosed herein or otherwise known in the art). In particular embodiments, the CD2 binding compositions of the invention are not single chain antibodies.

In some embodiments, the multivalent and monovalent multispecific composition (e.g., an MRD-containing antibody) binds human CD2 and a CD2 ortholog from another organism. In additional embodiments, the multivalent and monovalent multispecific composition binds human CD2 and a CD2 ortholog from another primate. In further embodiments, the multivalent and monovalent multispecific composition binds human CD2 and a CD2 ortholog from cynomolgus monkey or rhesus monkey.

In some embodiments, the multivalent and monovalent multispecific composition (e.g., an MRD-containing antibody) binds a target on a myeloid cell. In some embodiments, the multivalent and monovalent multispecific composition (e.g., an MRD-containing antibody) binds (1) a target on a cell, tissue, or infectious agent of interest (e.g., a tumor antigen on a tumor cell) and (2) a target on an immune accessory cell (e.g., myeloid cell) so as to juxtapose myeloid cells with the cell, tissue, or infectious agent of interest. In some embodiments, the multivalent and monovalent multispecific composition has multiple binding sites for (i.e., multivalently binds) a target on a myeloid cell. In other embodiments, the multivalent and monovalent multispecific composition has a single binding site for (i.e., monovalently binds) a target on an accessory cell (e.g., myeloid cell). In some embodiments the single binding site is an MRD. In other embodiments, the single binding site is an antibody antigen binding domain. In further embodiments, binding of the multivalent and monovalent multispecific composition does not elicit a signal when the composition binds a target on a myeloid cell. In some embodiments, the multivalent and monovalent multispecific composition binds an Fc gamma receptor selected from CD16 (i.e., Fc gamma RIII), CD64 (i.e., Fc gamma RI), and CD32 (i.e., Fc gamma RII). In particular embodiments, the multivalent and monovalent multispecific composition binds CD64 (i.e., Fc gamma RI). In some embodiments, the multivalent and monovalent multispecific composition binds a target selected from, MHC class 2 and its invariant chain, TLR1, TLR2, TLR4, TLR5 and TLR6. In additional embodiments, the multivalent and monovalent multispecific composition binds at least 2, 3, 4, or 5 targets on the cell, tissue, or infectious agent of interest. According to some embodiments, at least 1, 2, 3, 4, 5 or more of the targets of the multivalent and monovalent multispecific composition are located on a cell surface. In additional embodiments, 1, 2, 3, 4, 5 or more targets bound by the multivalent and monovalent multispecific composition are a tumor antigen (e.g., tumor antigens and tumor/cancer associated antigens). In additional embodiments, 1, 2, 3, 4, 5 or more targets bound by the multivalent and monovalent multispecific composition are associated with a disease or disorder of the immune system. In additional embodiments, 1, 2, 3, 4, 5 or more targets bound by the multivalent and monovalent multispecific composition are associated with a disease or disorder of the skeletal system (e.g., osteoporosis), cardiovascular system, nervous system, or an infectious disease.

In some embodiments, the multivalent and monovalent multispecific composition (e.g., an MRD-containing antibody) binds a target of interest on a cancer cell. In additional embodiments, the multivalent and monovalent multispecific composition binds a target of interest on an immune cell. In further embodiments, the multivalent and monovalent multispecific composition binds a target of interest on a diseased cell. In other embodiments, the multivalent and monovalent multispecific composition (e.g., an MRD-containing antibody) binds a target of interest on an infectious agent (e.g., a bacterial cell or a virus).

In further embodiments, the invention encompasses a method of treating a disease or disorder by administering to a patient in need thereof, a therapeutically effective amount of a multivalent and monovalent multispecific composition of the invention. Particular embodiments are directed to a method of treating a disease or disorder by administering to a patient in need thereof, a therapeutically effective amount a multivalent and monovalent multispecific composition (e.g., an MRD-containing antibody) that has a single binding site for a target (i.e., that monovalently binds a target). In some embodiments, the administered multivalent and monovalent multispecific composition has a single binding site for a target on a leukocyte, such as a T-cell (e.g., CD3). In additional embodiments, the administered multivalent and monovalent multispecific composition has a single binding site for a target on a leukocyte, such as a T-cell (e.g., CD3) and multiple binding sites for (i.e., is capable of multivalently binding) a target located on a cell or tissue of interest (e.g., a tumor antigen on a tumor cell).

In further embodiments, the invention is directed to treating a disease or disorder by administering to a patient a therapeutically effective amount of a multivalent and monovalent multispecific composition (e.g., an MRD-containing antibody) that has a single binding site for a target (i.e., that monovalently binds a target) and multiple binding sites for 1, 2, 3, 4, 5 or more different targets.

In additional embodiments, the invention is directed to treating a disease or disorder by administering to a patient in need thereof, a therapeutically effective amount of a multivalent and monovalent multispecific composition (e.g., an MRD-containing antibody) that has a single binding site for CD3 (e.g., CD3 epsilon) that monovalently binds CD3 and multiple binding sites for 1, 2, 3, 4, 5 or more different targets.

According to some embodiments, the tumor cell is from a cancer selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer.

In some embodiments, the MRD(s) and the antibody in the MRD-containing antibody are antagonists of their respective targets. In other embodiments, the MRD(s) and the antibody in the MRD-containing antibody are agonists of their respective target. In yet other embodiments, at least one of the MRDs in the MRD-containing antibody is an antagonist of its target molecule and the antibody is an agonist of its target molecule. In yet another embodiment, at least one of the MRDs in the MRD-containing antibody is an agonist of its target molecule, and the antibody is an antagonist of its target molecule.

In some embodiments, both the MRD(s) and the antibody in the MRD-containing antibody bind to soluble factors. In some embodiments, both the MRD(s) and the antibody in the MRD-containing antibody bind to cell surface molecules. In some embodiments, at least one MRD in the MRD-containing antibody binds to a cell surface molecule and the antibody in the MRD-containing antibody binds to a soluble factor. In some embodiments, at least one MRD in the MRD-containing antibody binds to a soluble factor and the antibody in the MRD-containing antibody binds to a cell surface molecule.

An improved multivalent and monovalent multispecific composition (e.g., MRD-containing antibody) that specifically binds a desired target or targets can also be prepared based on a previously known MRD or multivalent and monovalent multispecific composition (e.g., MRD-containing antibody). For example, 1, 2, 3, 4, 5, 6, 7, 8, 9, 10, 10-20, 20-30, 30-50, 50-100, 100-150 or more than 150 amino acid substitutions, deletions or insertions can be introduced into an MRD or multivalent and monovalent multispecific composition (e.g., MRD-containing antibody) sequence and the resulting MRD or multivalent and monovalent multispecific composition (e.g., MRD-containing antibody) can be screened for binding to the desired target or targets, for antagonizing target activity, or for agonizing target activity as described in the examples or using techniques known in the art.

Additional peptide sequences may be added, for example, to enhance the in vivo stability of the MRD or affinity of the MRD for its target.

In certain embodiments, the binding of a multivalent and monovalent multispecific composition (e.g., MRD-containing antibody) to its target (e.g., a cell) is enhanced compared to the binding of the MRD alone, the antibody alone, and/or a combination of the MRD and antibody. In some embodiments, the binding is at least about 2-fold, at least about 5-fold, at least about 10-fold, at least about 20-fold, at least about 50-fold, at least about 75-fold, at least about 100-fold, at least about 500-fold, or at least about 1000-fold improved.

In addition, in some embodiments, the binding of a multivalent and monovalent multispecific composition (e.g., MRD-containing antibody) to a target (e.g., a cell or a molecule containing multiple epitopes) expressing both the MRD target and the antibody target is enhanced compared to the binding of the multivalent and monovalent multispecific composition (e.g., MRD-containing antibody) to a target (e.g., a cell or a molecule containing multiple epitopes) expressing only the MRD target or only the antibody target. In some embodiments, the binding is at least about 2-fold, at least about 5-fold, at least about 10-fold, at least about 20-fold, at least about 50-fold, at least about 75-fold, at least about 100-fold, at least about 500-fold, or at least about 1000-fold improved. This increased avidity can enable multivalent and multispecific compositions (e.g., MRD-containing antibodies) to bind to targets that have previously been difficult to target, e.g., G-protein coupled receptors and carbohydrate molecules.

In addition, in some embodiments, the binding of a multivalent and monovalent multispecific composition (e.g., MRD-containing antibody) to an MRD target is enhanced in a region (e.g., of the body) where the antibody target is localized compared to a region where the antibody target is not expressed or is expressed at a lower level. In some embodiments, the binding of a multivalent and monovalent multispecific composition (e.g., MRD-containing antibody) to an antibody target is enhanced in a region (e.g., of the body) where the MRD target is localized compared to a region where the MRD target is not expressed or is expressed at a lower level. In some embodiments, the binding is at least about 2-fold, at least about 5-fold, at least about 10-fold, at least about 20-fold, at least about 50-fold, at least about 75-fold, at least about 100-fold, at least about 500-fold, or at least about 1000-fold improved.

In preferred embodiments, the multivalent and monovalent multispecific composition (e.g., MRD-containing antibody) retains particular activities of the parent antibody. Thus, in certain embodiments, the multivalent and monovalent multispecific composition (e.g., MRD-containing antibody) is capable of inducing complement dependent cytotoxicity. In certain embodiments, the multivalent and monovalent multispecific composition (e.g., MRD-containing antibody) is capable of inducing antibody dependent cell mediated cytotoxicity (ADCC). In additional embodiments, the multivalent and monovalent multispecific composition (e.g., MRD-containing antibody) is capable of inducing apoptosis. In additional embodiments, the multivalent and monovalent multispecific composition (e.g., MRD-containing antibody) is capable of reducing tumor volume. In additional embodiments, the multivalent and multispecific compositions (e.g., MRD-containing antibodies) are capable of inhibiting tumor growth.

In some embodiments, the multivalent and monovalent multispecific composition (e.g., MRD-containing antibody) shows improved activity or pharmacodynamic properties compared to the corresponding antibody without the attached MRD. Thus, in certain embodiments, the multivalent and monovalent multispecific composition (e.g., MRD-containing antibody) has greater avidity than the corresponding antibody without the attached MRD. In other embodiments, the multivalent and monovalent multispecific composition (e.g., MRD-containing antibody) results in increased receptor aggregation compared to the corresponding antibody without the attached MRD. In another embodiment, the multivalent and monovalent multispecific composition (e.g., MRD-containing antibody) antagonizes target activity to a greater extent than the corresponding antibody without the attached MRD. In another embodiment, the multivalent and monovalent multispecific composition (e.g., MRD-containing antibody) agonizes target activity to a greater extent than the corresponding antibody without the attached MRD. In another embodiment, the multivalent and monovalent multispecific composition (e.g., MRD-containing antibody) has an improved pharmacodymamic profile than the corresponding antibody without the attached MRD.

In another embodiment, the MRD-containing antibody has a greater therapeutic efficacy than the corresponding antibody without the attached MRD.

In other embodiments, the multivalent and multispecific compositions (e.g., MRD-containing antibodies) have one or more of the following effects: inhibit proliferation of tumor cells, reduce the tumorigenicity of a tumor, inhibit tumor growth, increase patient survival, trigger cell death of tumor cells, differentiate tumorigenic cells to a non-tumorigenic state, or prevent metastasis of tumor cells.

In certain embodiments, the multivalent and monovalent multispecific composition (e.g., MRD-containing antibody) is at least as stable as the corresponding antibody without the attached MRD. In certain embodiments, the multivalent and monovalent multispecific composition (e.g., MRD-containing antibody) is more stable than the corresponding antibody without the attached MRD. MRD-antibody stability can be measured using methods known to those in the art, including, for example, ELISA techniques. In some embodiments, the multivalent and monovalent multispecific composition (e.g., MRD-containing antibody) is stable in whole blood at 37° C. for at least about 10 hours, at least about 15 hours, at least about 20 hours, at least about 24 hours, at least about 25 hours, at least about 30 hours, at least about 35 hours, at least about 40 hours, at least about 45 hours, at least about 48 hours, at least about 50 hours, at least about 55 hours, at least about 60 hours, at least about 65 hours, at least about 70 hours, at least about 72 hours, at least about 75 hours, at least about 80 hours, at least about 85 hours, at least about 90 hours, at least about 95 hours, or at least about 100 hours.

In certain embodiments, the multivalent and monovalent multispecific composition (e.g., MRD-containing antibody) has at least the same affinity for Fc receptors as the corresponding parent antibody. In other nonexclusive embodiments, the multivalent and monovalent multispecific composition (e.g., MRD-containing antibody) has at least the same affinity for complement receptors as the corresponding parent antibody. In other nonexclusive embodiments, the multivalent and monovalent multispecific composition (e.g., MRD-containing antibody) has at least the same half-life as the corresponding parent antibody. In other embodiments, the multivalent and monovalent multispecific composition (e.g., MRD-containing antibody) can be expressed at levels commensurate with the corresponding parent antibody.

In additional embodiments, the multivalent and monovalent multispecific composition (e.g., MRD-containing antibody) has an increased affinity for Fc receptors compared to the corresponding parent antibody. In other nonexclusive embodiments, the multivalent and monovalent multispecific composition (e.g., MRD-containing antibody) has an increased affinity for complement receptors compared to the corresponding parent antibody. In other nonexclusive embodiments, the multivalent and monovalent multispecific composition (e.g., MRD-containing antibody) has an increased half-life compared to the corresponding parent antibody. In other embodiments, the multivalent and monovalent multispecific composition (e.g., MRD-containing antibody) can be expressed at increased levels compared to that of the corresponding parent antibody.

Immunoconjugates (MRD-Containing Antibody Drug Conjugates)

The use of antibody-drug conjugates for the local delivery of cytotoxic agents, allows targeted delivery of the drug to tumors, and intracellular accumulation therein, where systemic administration of these unconjugated drug agents may result in unacceptable levels of toxicity to normal cells as well as the tumor cells sought to be eliminated (Baldwin et al., Lancet pages 603-05 (1986); Thorpe, "Antibody Carriers Of Cytotoxic Agents In Cancer Therapy: A Review," in Monoclonal Antibodies '84: Biological And Clinical Applications, A. Pinchera et al., (ed.s), pp. 475-506) (1985)).

In additional embodiments, the invention encompasses a multivalent and monovalent multispecific composition (e.g., an MRD-containing antibody) that is covalently or otherwise associated with a cytotoxic agent (payload) (i.e., as multivalent and monovalent multispecific-cytoxic agent complexes (e.g., MRD-containing antibody-cytoxic agent complexes). According to some embodiments, the cytoxic agent is covalently attached to a multivalent and monovalent multispecific composition (e.g., MRD-containing antibody) by a linker. According to some embodiments, the linker attaching the multivalent and monovalent multispecific composition and the cytotoxic agent is cleavable by a protease. In additional embodiments, the cytotoxic agent is a chemotherapeutic agent, growth inhibitory agent, toxin (e.g., an enzymatically active toxin of bacterial, fungal, plant, or animal origin, or fragments thereof), a radioactive isotope (i.e., a radioconjugate) or a prodrug. Methods of using immunoconjugates (MRD-containing Antibody drug conjugates) are also encompassed by the invention.

Cytotoxic agents that may be covalently or otherwise associated with multivalent and multispecific compositions (e.g., an MRD-containing antibody) include, but are not limited to any agent that is detrimental to (e.g., kills) cells. Cytotoxins useful in the compositions and methods of the invention include, inter alia, alkylating agents, intercalating agents, antiproliferative agents, anti-mititotic agents, tubulin binding agents, vinca alkaloids, enediynes, trichothecenes, podophyllotoxins or podophyllotoxin derivatives, the pteridine family of drugs, taxanes, anthracyclines (e.g., daunorubicin (formerly daunomycin) and doxorubicin), antibiotics (e.g., dactinomycin (formerly actinomycin, dolastatins (e.g., dolastatin 10, dolastatin 11, and dolastatin 15)), topoiosomerase inhibitors, and platinum complex chemotherapeutic agents (e.g., cis-platinum).

In some embodiments, compositions of the invention include a cytoxic agent that is a tubulin depolymerizing agent. Thus, in some embodiments, compositions of the invention include an auristatin or an auristatin derivative or analog. In one embodiment, compositions of the invention contain monomethyl auristatin E (MMAE). In another embodiment, compositions of the invention contain monomethyl auristatin F (MMAF). In additional embodiments, an immunoconjugate composition of the invention contains dolastatin or a dolastatin peptidic analog or derivative, e.g., an auristatin (see, e.g., U.S. Pat. Nos. 5,635,483, 5,780,588, and 5,663,149).

In additional embodiments, compositions of the invention include a maytansinoid molecule. Maytansinoids are mitotic inhibitors which act by inhibiting tubulin polymerization. Methods of making maytansinoids and their therapeutic use are disclosed, for example, in U.S. Pat. Nos. 5,208,020; 5,416,064, 6,441,163 and European Pat. EP 0 425 235 B1; each of which is herein incorporated by reference in its entirety.

Thus, in some embodiments, the cytotoxin is a maytansinoid or a maytansinoid derivative or analog. Maytansinoid drug moieties are attractive drug moieties in antibody-drug conjugates because they are: (i) relatively accessible to prepare by fermentation or chemical modification or derivatization of fermentation products, (ii) amenable to derivatization with functional groups suitable for conjugation through non-disulfide linkers to antibodies, (iii) stable in plasma, and (iv) effective against a variety of tumor cell lines. Maytansine compounds suitable for use as maytansinoid drug moieties are well known in the art, and can be isolated from natural sources according to known methods, produced using genetic engineering techniques (see Yu et al PNAS 99:7968-7973 (2002)), or maytansinol and maytansinol analogues can be prepared synthetically according to known methods.

In particular embodiments compositions of the invention include the maytansinoid DM1 (N(2')-deacetyl-N(2')-(3-mercapto-1-oxopropyl)-maytansine). In other particular embodiments compositions of the invention include the maytansinoid DM2. In additional embodiments, compositions of the invention include the maytansinoid DM3 (N(2')-deacetyl-N2-(4-mercapto-1-oxopentyl)-maytansine) or DM4 (N(2')-deacetyl-N2-(4-mercapto-4-methyl-1-oxopentyl)-maytansine).

In some embodiments, compositions of the invention include a cytoxic agent that is an alkylating agent. In particular embodiments, the cytotoxic agent is selected from mechlorethamine, thiotepa, thioepa chlorambucil, melphalan, carmustine (BSNU), BCNU lomustine (CCNU), cyclothosphamide, busulfan, dibromomannitol, and streptozoicin.

In other embodiments, compositions of the invention include a cytoxic agent that is an antimetabolite. In particular embodiments, the cytotoxic agent is selected from methotrexate, dichloromethotrexate, 6-mercaptopurine, 6-thioguanine, cytarabine, 5-fluorouracil and 5-fluorouracil decarbazine.

In additional embodiments, the multivalent and multispecific composition-drug conjugate (e.g., MRD-containing antibody-drug conjugate) is capable of producing double-stranded DNA breaks. In further embodiments, the MRD-containing antibody-drug conjugate contains a member of the calicheamicin family of antibiotics capable of producing double-stranded DNA breaks at sub-picomolar concentrations. In further embodiments, a multivalent and multispecific composition-drug conjugate (e.g., MRD-containing antibody-drug conjugate) contains calicheamycin. For the preparation of conjugates of the calicheamicin family, see e.g., U.S. Pat. Nos. 5,712,374, 5,714,586, 5,739,116, 5,767, 285, 5,770,701, 5,770,710, 5,773,001, and 5,877,296 (all to American Cyanamid Company). Structural analogues of calicheamicin which can be contained in the multivalent and multispecific composition-drug conjugate (e.g., MRD-containing antibody-drug conjugate) of the invention include, but are not limited to, gamma$_1^I$, alpha$_2^I$, alpha$_3^I$, N-acetylamma$_1^I$, PSAG and theta$_1^I$ (Hinman et al., Cancer Research 53:3336-3342 (1993), and Lode et al., Cancer Research 58:2925-2928 (1998).

In other embodiments, multivalent and multispecific composition-drug conjugate (e.g., MRD-containing antibody-drug conjugate) compositions of the invention include a cytoxic agent selected from adriamicin, doxorubicin, mitomycin C, busulfan, cytoxin, chlorambucil, etoposide, etoposide phosphate, CC-1065, duocarmycin, KW-2189, CC1065, taxotere (docetaxel), methopterin, aminopterin, topotecan, camptothecin, porfiromycin, bleomycin, teniposide, esperamicins, mithramycin, anthramycin (AMC), fludarabine, tamoxifen, taxotere (docetaxel), cytosine arabinoside (Ara-C), adenosine arabinoside, cisplatin, carboplatin, cis-dichlorodiamine platinum (II) (DDP) cisplatin, chloroquine, cyclosporin A, docetaxel, paclitaxel, taxol, vinorelbine, vindesine, cytochalasin B, gramicidin D, ethidium bromide, emetine, mitomycin, ifosfamide, cyclophosphamide, tenoposide, carminomycin, porfiromycin, dihydroxy anthracin dione, mitoxantrone, mithramycin, dactinomycin, actinomycin D, puromycin 1-dehydrotestosterone, adriamycin, glucocorticoids, procaine, tetracaine, lidocaine, propranolol, epithiolone, QFA, combretastatin, combretastatin A4 phosphate, vinblastine, vincristine, colchicine, geldanamycin, doxorubicinchlorambucil, Auristatin F phenylene diamine (AFP)), monomethylauristatin, the family of agents known collectively LL-E33288 complex described in U.S. Pat. Nos. 5,053,394, 5,770,710, as well as esperamicins (U.S. Pat. No. 5,877,296) or a derivative or analog thereof and derivatives and analog thereof.

Additional suitable toxins and chemotherapeutic agents are described in Remington's Pharmaceutical Sciences, 19th Ed. (Mack Publishing Co. 1995), and in Goodman and Gilman's The Pharmacological Basis of Therapeutics, 7th Ed. (MacMillan Publishing Co. 1985). Moreover, for further discussion of types of cytotoxins, linkers and other methods that can be use or routinely adapted to conjugate therapeutic agents to the MRD-comprising antibody complex, see e.g., Intl. Appl. Publ. WO2007/059404; Saito et al., Adv. Drug Deliv. Rev. 55:199-215 (2003); Trail et al., Cancer Immunol Immunother. 52:328-337 (2003); Payne, Cancer Cell 3:207-212 (2003); Allen, Nat. Rev. Cancer 2:750-763 (2002); Pastan et al., Curr. Opin. Investig. Drugs 3:1089-1091 (2002); and Senter et al., Adv. Drug Deliv. Rev. 53:247-264 (2001), each of which is hereby incorporated by reference in its entirety.

Cytotoxin chemotherapeutic agents that can be used in the immunoconjugates of the invention (e.g., multivalent and multispecific composition-drug conjugates such as MRD-containing antibody-drug conjugates) include poisonous lectins and plant or other toxins (e.g., ricin, abrin, modeccin, botulina, and diphtheria toxins). It is envisioned that multiple copies of a toxin or combinations of various toxins can optionally be coupled to a multispecific and multivalent composition of the invention (e.g., an MRD-containing antibody) thereby providing additional cytotoxicity. Enzymatically active toxins and fragments thereof that can be used in compositions of the invention include, but are not limited to diphtheria A chain, nonbinding active fragments of diphtheria toxin, exotoxin A chain (from *Pseudomonas aeruginosa*), *Pseudomonas* exotoxin, *Pseudomonas* endotoxin, ricin A chain, abrin A chain, modeccin A chain, alpha-sarcin, *Aleurites fordii* proteins, ribonuclease, DNase I, Staphylococcal enterotoxin-A, dianthin proteins, *Phytolaca americana* proteins (PAPI, PAPII, and PAP-S), *momordica charantia* inhibitor, curcin, crotin, *sapaonaria officinalis* inhibitor, gelonin, mitogellin, restrictocin, phenomycin, enomycin, and the tricothecenes. See, for example, Pastan et al., Cell 47:641 (1986), Goldenberg et al., Cancer Journal for Clinicians 44:43 (1994) and Intl Appl. Publ. Nos. WO93/21232 and WO93/21232, each of which is herein incorporated by reference in its entirety.

Typically, peptide-based drug moieties can be prepared by forming a peptide bond between two or more amino acids and/or peptide fragments. Such peptide bonds can be prepared, for example, according to the liquid phase synthesis method (see E. Schroder and K. Lubke, "The Peptides", volume 1, pp. 76-136, 1965, Academic Press) that is well known in the field of peptide chemistry. The auristatin/dolastatin drug moieties may be prepared according to the methods of: U.S. Pat. Nos. 5,635,483 and 5,780,588; Pettit et al., J. Am. Chem. Soc. 111:5463-5465 (1989); Pettit et al., Anti-Cancer Drug Design 13:243-277 (1998); Pettit et al., Synthesis 719-725 (1996); Pettit et al., J. Chem. Soc. Perkin Trans. 15:859-863 (1996); and Doronina et al., Nat. Biotechnol 21(7):778-784 (2003).

According to some embodiments, the compositions of the invention comprise a highly radioactive atom. A variety of radioactive isotopes are available for the production of radioconjugated multivalent and multispecific compositions (e.g., MRD-containing antibodies). Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the conjugate is used for detection, it may comprise a radioactive atom for scintiographic studies, for example $tc^{99m}$ or $I^{123}$, or a spin label for nuclear magnetic resonance (NMR) imaging (also known as magnetic resonance imaging, mri), such as iodine-123 again, iodine-131, indium-111, fluorine-19, carbon-13, nitrogen-15, oxygen-17, gadolinium, manganese or iron.

The radio- or other labels can be incorporated in the conjugate using techniques known in the art. For example, the peptide can be biosynthesized or can be synthesized by chemical amino acid synthesis using suitable amino acid precursors involving, for example, fluorine-19 in place of hydrogen. Labels such as $tc^{99m}$ or $I^{123}$, $Re^{186}$, $Re^{188}$ and $In^{111}$ can be attached via a cysteine residue in the peptide. Yttrium-90 can be attached via a lysine residue. The IODO-GEN method (Fraker et al Biochem. Biophys. Res. Commun. 80: 49-57 (1978)) can be used to incorporate iodine-123. "Monoclonal Antibodies in Immunoscintigraphy" (Chatal, CRC Press 1989) describes in detail other methods that can be routinely applied to label the compositions of the invention.

A linker can be a "cleavable linker," facilitating release of a drug in the cell. For example, an acid-labile linker (e.g., hydrazone), protease-sensitive (e.g., peptidase-sensitive) linker, photolabile linker, dimethyl linker or disulfide-containing linker (Chari et al., Cancer Research 52:127-131 (1992); U.S. Pat. No. 5,208,020, U.S. Pat. Appl. Publ. No. 20110293513) can be used. Thus, the invention encompasses multivalent and multispecific compositions containing one or more linkers that can contain any of a variety of groups as part of its chain that will cleave in vivo, e.g., in a cell, at a rate which is enhanced relative to that of constructs that lack such groups. Also provided are conjugates of the linker arms with therapeutic and diagnostic agents. The linkers are useful to form prodrug analogs of therapeutic agents and to reversibly link a therapeutic or diagnostic agent (e.g., a cytotoxin or MRD) to a targeting agent, a detectable label, or a solid support. The linkers can be stable in plasma so as not to release an MRD or cytotoxic agent. In the case of cytotoxins the linkers can be stable in plasma and labile once internalized so as to release the cytotoxin in an active form.

MRDs and/or cytotoxic agents are optionally attached to one another or to the multivalent and monovalent multispecific composition (e.g., MRD-containing antibody) of the invention with a linker as described herein or otherwise known in the art. Conjugates of the MRD-containing antibody with an MRD or a cytotoxic agent can be made using a variety of bifunctional protein coupling agents known in the art, including, but not limited to, coupling agents containing a group selected from: 6-maleimidocaproyl (MC), maleimidocaproyl-polyethylene glycol ("MC(PEG)6-OH" (amenable to attachment to antibody cysteines)), maleimidopropanoyl (MP), MPBH, valine-citrulline (val-cit (exemplary dipeptide in a protease cleavable linker)), methyl-valine-citrulline ("Me-Val-CitN," a linker in which a peptide bond has been modified to prevent its cleavage by cathepsin B) alanine-phenylalanine (ala-phe), p-aminobenzyloxycarbonyl (PAB (an example of a "self immolative" linker component)), valine-citrullin-p-aminobenzyloxycaronyl ("vc-PAB"), N-Succinimidyl 4-(2-pyridylthio) pentanoate (SPP), N-succinimidyl 4-(N-maleimidomethyl) cyclohexane-1 carboxylate (SMCC), LC-SMCC, N-Succinimidyl (4-iodo-acetyl) aminobenzoate (SIAB), IT (iminothiolane), SPDP (N-succinimidyl-3-(2-pyridyldithio) propionate), 6-maleimidocaproyl-valine-citrulline-p-aminobenzyloxy-carbonyl (MC-vc-PAB), ethyleneoxy-$CH_2CH_2O$— as one or more repeating units ("EO" or "PEO"), BMPS, EMCS, GMBS, HBVS, MBS, SBAP, SIA, SMPB, SMPH, sulfo-EMCS, sulfo-GMBS, sulfo-KMUS, sulfo-MBS, sulfo-SMCC, sulfo-SIAB, sulfo-SMPB, SVSB (succinimidyl-(4-vinylsulfone) benzoate), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). Additional linker components are known in the art and some are described herein.

In some embodiments, the multivalent and monovalent multispecific composition is covalently attached to a cytotoxic agent via a linker at 1-5, 5-10, 1-10, or 1-20 sites on the multivalent and multispecific composition. According to additional embodiments, the multivalent and monovalent multispecific composition is covalently attached to a cytotoxic agent via a linker at more than 2, 5 or 10 sites on the multivalent and multispecific composition.

In additional embodiments, the multivalent and monovalent multispecific composition (e.g., MRD containing antibody) complex is associated with a prodrug. Prodrug synthesis, chemical linkage to antibodies, and pharmacodynamic properties are known in the art and can routinely be applied to make and use multivalent and multivalent compositions of the invention that contain prodrugs, such as, MRD-containing antibody-prodrug compositions. See, e.g., Intl. Publ. No. WO96/05863 and in U.S. Pat. No. 5,962,216, each of which is herein incorporated by reference in its entirety.

Alternatively, a fusion protein comprising an antibody and a cytotoxic agent can be made, e.g., by recombinant techniques or peptide synthesis. A recombinant DNA molecule can comprise regions encoding the antibody and cytotoxic portions of the conjugate either adjacent to one another or separated by a region encoding a linker peptide which does not destroy the desired properties of the conjugate.

The multivalent and monovalent multispecific composition (e.g., MRD-containing antibody) composition of the invention also can be conjugated to a radioactive isotope to generate cytotoxic radiopharmaceuticals, also referred to as radioimmunoconjugates. Examples of radioactive isotopes that can be conjugated to multivalent and monovalent multispecific compositions (e.g., MRD containing antibodies) for use diagnostically or therapeutically include, but are not limited to, iodine$^{131}$, indium$^{111}$, yttrium$^{90}$, and lutetium$^{177}$. Methods for preparing radioimmunconjugates are established in the art. Examples of radioimmunoconjugates are commercially available, including Zevalin™. (IDEC Pharmaceuticals) and Bexxar™ (Corixa Pharmaceuticals), and similar methods can be used to prepare radioimmunoconjugates using the MRD-containing antibodies of the invention.

Methods for the conjugation of linker-drug moieties to cell-targeted proteins such as antibodies are known in the art and include those described for example, in U.S. Pat. Nos. 5,208,020 and 6,441,163; Intl. Appl. Publ. Nos. WO2005037992, WO2005081711, and WO2006/034488, each of which is herein incorporated by reference in its entirety. See, also e.g., Arnon et al., "Monoclonal Antibodies For Immunotargeting Of Drugs In Cancer Therapy", in Monoclonal Antibodies And Cancer Therapy, Reisfeld et al., (eds.), pp. 243-56 (Alan R. Liss, Inc. 1985); Hellstrom et al., "Antibodies For Drug Delivery", in Controlled Drug Delivery (2nd Ed.), Robinson et al., (eds.), pp. 623-53 (Marcel Dekker, Inc. 1987); Saito et al., Adv. Drug Deliv. Rev. 55:199-215 (2003); Trail et al., Cancer Immunol. Immunother. 52:328-337 (2003); Payne, Cancer Cell 3:207-212 (2003); Allen et al., Nat. Rev. Cancer 2:750-763 (2002); Pastan et al., Curr. Opin. Investig. Drugs 3:1089-1091 (2002); and Senter et al., Adv. Drug Deliv. Rev. 53:247-264 (2001), the contents of each of which is herein incorporated by reference in its entirety.

In some embodiments, a multivalent and monovalent multispecific composition of the invention comprising a cytotoxic agent (e.g., an MRD-containing antibody-cytotoxic agent conjugate) and may generally be referred to herein as an immunoconjugate. In some embodiments, an immunoconjugate of the invention binds a cell surface target that is internalized into the cell. In further embodiments, the binding of an immunoconjugate of the invention (e.g., an MRD-containing antibody-cytotoxic agent conjugate) to a cell surface target results in the internalization of the immunoconjugate into the cell in vitro. In further embodiments, the binding of immunoconjugate to a cell surface target results in the internalization of the composition into the cell in vivo. Methods for treating a patient described herein can comprise: administering to the patient a therapeutically effective amount of an immunoconjugate (e.g., a multivalent and monovalent multispecific composition of the invention comprising a cytotoxic agent, such as an MRD-containing antibody-cytotoxic agent conjugate) that comprises a cytotoxic agent and binds a target that is internalized into a cell. In some embodiments, the immunoconjugate comprises a cytotoxic agent disclosed herein. In additional embodiments, the immunoconjugate comprises a cytotoxic agent selected from an alkylating agent, antiproliferative agent, tubulin binding agent, vinca alkaloid, enediyne, podophyllotoxin, podophyllotoxin derivative, a member of the pteridine family of drugs, taxane, a dolastatin, topoiosomerase inhibitor, or a platinum complex chemotherapeutic agent. In further embodiments, the cytoxic agent is a maytansinoid or a maytansinoid derivative or analog. In specific embodiments the cytoxic agent is the maytansinoid DM1, DM2, or DM3. In additional embodiments, the cytotoxic agent is auristatin or an auristatin derivative or analog. In specific embodiments the cytoxic agent is MMAE or MMAF. The cytotoxic agents are optionally attached to the other components of the immunoconjugate by a linker. In some embodiments the cytotoxic agent is attached to the other components of the immunoconjugate by an enzyme cleavable linker. In additional embodiments, the cytotoxic agent is attached to the other components of the immunoconjugate by an acid-labile linker.

In further embodiments, the cytoxic agent of an immunoconjugate of the invention has a free drug potency of less than $10^{-7}$M, $10^{-8}$M, or $10^{-9}$M. In additional embodiments, the cytoxin has a free drug potency of $10^{-8}$ to $10^{-11}$ M.

In some embodiments, a target bound by the immunoconjugate is selected from CD19, CD22, CD30, CD33, CD56, CD70, CD79a, CD80, CD83, CD95, CD126, CD133, CD138, PSMA, EphA2, ErbB2 (CD340), SLC44A4, MN (carbonic anhydrase IX), GPNMB (glycoprotein non-metastatic melanoma protein), Cripto, and αV integrin. In additional embodiments, a target bound by the immunoconjugate is selected from CD1, CD1a, CD2, CD3, CD4, CD5, CD8, CD11A, CD14, CD15, CD16, CD18, CD19, CD20, CD25, TNFRSF5 (CD40), CD64, CD74, CD79, CD105, CD174, CD205, CD227, CD326, CD340, MUC16, EGP-1, EGP-2, EGF receptor (ErbB1), ErbB2, ErbB3, Factor H, FHL-1, Flt-3, folate receptor, Ga 733, GROB, HMGB-1, hypoxia inducible factor (HIF), HM1.24, HER-2/neu, insulin-like growth factor (ILGF), IFN-gamma, IFN-alpha, IFN-beta, IL2R, IL4R, IL6R, IL13R, IL15R, IL17R, IL18R, IL2, IL6, IL8, IL12, IL15, IL17, IL18, IL25, IP-10, IGF-1R, Ia, HM1.24, HCG, HLA-DR, ED-B, TMEFF2, EphB2, FAP (fibroblast activation protein), mesothelin, EGFR, TAG-72, GD2 (encoded by the B4GALNT1 gene), and 5T4.

In additional embodiments, a target bound by the immunoconjugate is a myeloid and hematopoietic target selected from CD33, CD64, TNFRSF5 (CD40), CD56, and CD138. In further embodiments, a target bound by the immunoconjugate is a carcinoma target selected from EpCam, GD2, EGFR, CD74, CD227, CD340, MUC16, GD2, GPNMB, PSMA, crypto, TMEFF2, EphB2, 5t4, mesothelin, TAG-72, and MN.

In other embodiments, a target bound by the immunoconjugate is a B cell target selected from CD19/CD21, CD20, CD22, TNFRSF5 (CD40), CD70, CD79a, CD79b, and CD205. In additional embodiments, a target bound by the immunoconjugate is a T cell target selected from CD25, CD30, TNFRSF5 (CD40), CD70, and CD205. In further embodiments, a target bound by an endothelial cell target selected from CD105, the stromal cell target FAP, and the vascular target ED-B.

In additional embodiments, an immunoconjugate of the invention binds to a cell surface tumor antigen and a second target that is associated with an escape pathway for resisting chemotherapy. In some embodiments, the cell surface tumor antigen is a member selected from EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC.

In further embodiments, an immunoconjugate binds P-glycoprotein (encoded by MDR1) and a cell surface antigen. In particular embodiments, the cell surface antigen is a tumor antigen. In further embodiments, the tumor antigen is a member selected from: EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC. In particular embodiments, the immunoconjugate competes for CD30 binding with SGN-35 (brentuximab). In additional embodiments, the immunoconjugate competes for ErbB2 binding with trastuzumab.

In further embodiments, an immunoconjugate binds MRP (Multidrug-Resistance associated Protein) and a cell surface antigen. In particular embodiments, the cell surface antigen is a tumor antigen. In further embodiments, the tumor antigen is a member selected from: EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC. In particular embodiments, the immunoconjugate competes for CD30 binding with SGN-35 (brentuximab). In additional embodiments the immunoconjugate competes for ErbB2 binding with trastuzumab.

Alternatively, a fusion protein comprising the antibody and cytotoxic agent may be made, e.g., by recombinant techniques or peptide synthesis. The length of DNA may comprise respective regions encoding the two portions of the conjugate either adjacent one another or separated by a region encoding a linker peptide which does not destroy the desired properties of the conjugate.

The following embodiments are further provided for any of the above immunoconjugates. In one embodiment, an immunoconjugate has in vitro or in vivo cell killing activity. In one embodiment, the linker is attached to the antibody through a thiol group on the antibody. In one embodiment, the linker is cleavable by a protease. In one embodiment, the linker comprises a val-cit dipeptide. In one embodiment, the linker comprises a p-aminobenzyl unit. In one embodiment, the p-aminobenzyl unit is disposed between the drug and a protease cleavage site in the linker. In one embodiment, the p-aminobenzyl unit is p-aminobenzyloxycarbonyl (PAB). In one embodiment, the linker comprises 6-maleimidocaproyl. In one embodiment, the 6-maleimidocaproyl is disposed between the antibody and a protease cleavage site in the linker. The above embodiments may occur singly or in any combination with one another.

The MRD-containing antibody of the present invention may also be conjugating to a prodrug-activating enzyme which converts a prodrug (e.g., a peptidyl chemotherapeutic agent, see e.g., WO81/01145) to an active anti-cancer drug. See, for example, WO88/07378 and U.S. Pat. No. 4,975,278 the contents of which are herein incorporated by reference in its entirety. The enzyme component of the immunoconjugate is preferably capable of acting on a prodrug in such a way so as to convert it into its more active, cytotoxic form. See, for example, Pastan et al., Cell, 47:641 (1986), and Goldenberg et al., Cancer Journal for Clinicians, 44:43 (1994). Enzymatically active toxins and fragments thereof which can be used include diphtheria A chain, non-binding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *momordica charantia* inhibitor, curcin, crotin, *sapaonaria officinalis* inhibitor, gelonin, mitogellin, restrictocin, phenomycin, enomycin and the tricothecenes. See, for example, WO93/21232.

In some embodiments, the multivalent and multispecific compositions of the invention (e.g., MRD-containing antibodies) are conjugated to a radioisotope, such as, $^{90}$Y, $^{125}$I, $^{131}$I, $^{123}$I, $^{111}$In, $^{105}$Rh, $^{153}$Sm, $^{67}$Cu, $^{67}$Ga, $^{166}$Ho, $^{177}$Lu, $^{186}$Re and $^{188}$Re using anyone of a number of well-known chelators or direct labeling. In other embodiments, the MRD-containing antibody is coupled to drugs, prodrugs or lymphokines such as, interferon. Compositions of the invention can be labeled with ligand reagents that bind, chelate or otherwise complex a radioisotope metal where the reagent is reactive with the engineered cysteine thiol of the antibody, using techniques known in the art such as, those described in Current Protocols in Immunology, Volumes 1 and 2, Coligen et al, Ed. Wiley-Interscience, New York, N.Y., Pubs. (1991). Chelating ligands which may complex a metal ion and that may have use in the compositions and methods of the invention include DOTA, DOTP, DOTMA, DTPA and TETA (Macrocyclics, Dallas, Tex.). Radionuclides can be targeted via complexation with the antibody-drug conjugates of the invention (Wu et al Nature Biotechnology 23(9): 1137-1146 (2005)). Linker reagents such as, DOTA-maleimide (4-maleimidobutyramidobenzyl-DOTA) can be prepared by the reaction of aminobenzyl-DOTA with 4-maleimidobutyric acid (Fluka) activated with isopropylchloroformate (Aldrich), following the procedure of Axworthy et al., Proc. Natl. Acad. Sci. USA 97(4):1802-1807 (2000)). DOTA-maleimide reagents react with the free cysteine amino acids of the cysteine engineered antibodies and provide a metal complexing ligand on the antibody (Lewis et al., Bioconj. Chem. 9:72-86 (1998)). Chelating linker labeling reagents such as, DOTA-NHS (1,4,7,10-tetraazacyclododecane-1,4,7,10-tetraacetic acid mono (N-hydroxysuccinimide ester) are commercially available (Macrocyclics, Dallas, Tex.).

Conjugates of the multivalent and multispecific compositions of the invention (e.g., MRD-containing antibodies) and cytotoxin can routinely be made using a variety of bifunctional protein-coupling agents such as, N-succinimidyl-3-(2-pyridyidithiol) propionate (SPDP), iminothiolane (IT), bifunctional derivatives of imidoesters (such as, dimethyl adipimidate HCL), active esters (such as, disuccinimidyl suberate), aldehydes (such as, glutareldehyde), bis-azido compounds (such as, bis(p-azidobenzoyl) hexanediamine), bis-diazonium derivatives (such as, bis-(p-diazoniumbenzoyl)-ethylenediamine), diisocyanates (such as, tolyene 2,6-diisocyanate), and bis-active fluorine compounds (such as, 1,5-difluoro-2,4-dinitrobenzene). In specific embodiments, the toxin is conjugate to an MRD-containing antibody through an enzyme-cleavable linker system (e.g., such as, that present in SGN-35). Conjugates of an MRD-containing antibody and one or more small molecule toxins, such as, a calicheamicin, maytansinoids, a trichothene, and CC1065, and the derivatives of these toxins that have toxin activity, can also be used.

In some embodiments, the MRD-containing antibody can be complexed, or have MRDs that bind with other immunologically active ligands (e.g., chemokines, cytokines, and antibodies or fragments thereof) wherein the resulting molecule binds to the neoplastic cell or other target as well as the chemokine, cytokine, or an effector cell such as, a T cell. In certain embodiments, these conjugates can be generated as fusion proteins. The enzymes of this invention can be covalently bound to the antibody by techniques well-known in the art such as, the use of the heterobifunctional cross-linking reagents discussed above. Alternatively, fusion proteins comprising at least the antigen-binding region of an antibody of the invention linked to at least a functionally active portion of an enzyme of the invention can be constructed using recombinant DNA techniques known in the art.

In some embodiments, the N-terminus or C-terminus of the antibody to which an MRD is operably linked in the MRD-antibody fusions is truncated. In preferred embodiments, this truncation does not prevent or reduce the ability of the antibody to bind to its target antigen via its antigen binding domain. In other embodiments, the truncation does not prevent or reduce Fc effector function, half-life and/or ADCC activity. In other embodiments, MRDs are attached in the terminal region of the antibody chain. More particularly, in certain embodiments, the MRD is attached within 1, 2, 3, 4, 5, 10, 15, 20, 25, 30, 35, 40, 45, or 50 residues of the C-terminal amino acid of the heavy chain. In other embodiments, the MRD is attached within 1, 2, 3, 4, 5, 10, 15, 20, 25, 30, 35, 40, 45, or 50 residues of the C-terminal amino acid of the light chain. In additional embodiments, the MRD is attached within 1, 2, 3, 4, 5, 10, 15, 20, 25, 30, 35, 40, 45, or 50 residues of the N-terminal amino acid of the heavy chain. In other embodiments, the MRD is attached within 1, 2, 3, 4, 5, 10, 15, 20, 25, 30, 35, 40, 45, or 50 residues of the N-terminal amino acid of the light chain. Thus, for example, a MRD that is linked to the N-terminal end of the heavy chain can be linked to the first, second, third, fourth, fifth, or tenth amino acid of the N-terminal chain of the heavy chain. For example, an MRD-antibody fusion containing an MRD linked to the N-terminal of the heavy chain may contain amino acids 1-3 of the heavy chain sequence linked to the MRD, which is linked to amino acid 4 of the heavy chain sequence.

In certain embodiments, one or more MRDs are attached to an antibody at locations other than the termini of the antibody light and heavy chains. The MRD can be attached to any portion of the antibody that does not prevent the ability of the antibody to bind its target. Thus, in some embodiments, the MRD is located outside the antibody combining site. For example, the MRD can be located within a heavy chain sequence or within a light chain sequence. By way of example only, the MRD can be located between the Fc domain and the hinge region, between the hinge region and the CH1 domain of the heavy chain, between the CH1 domain and the variable region of the heavy chain, or between the constant region and the variable region of the light chain.

Angiogenesis inhibitors targeting the vascular endothelial growth factor (VEGF) signaling pathways have been observed to provide at best transitory therapeutic benefits followed by restoration of tumor growth and progression due to an apparent ability of angiogenic tumors to adapt to the presence of these inhibitors. Without being bound by theory, it is believed that the multivalent and multispecific properties of multivalent and multispecific compositions (e.g., MRD-containing antibodies) that bind an angiogenesis target provide these compounds with an ability to extend anti-angiogenic therapeutic benefits beyond those observed from for example, conventional monoclonal antibody therapies by binding multiple distinct angiogenesis related targets and thereby disrupting resistance mechanisms available to the angiogenic tumor.

In one embodiment, an MRD-containing antibody binds 2 or more targets selected from: VEGF (i.e., VEGFA), VEGFB, FGF1, FGF2, FGF4, FGF7, FGF8b, FGF19, FGFR1 (e.g., FGFR1-IIIC), FGFR2 (e.g., FGFR2-IIIc, FGFR2-IIIb, and FGFR2-IIIc), FGFR3, TIE2, TNFSF2 (TNFa), FGFR3, EFNa1, EFNa2, ANG1, ANG2, IL6, IL8, IL18, HGF, PDGFA, PLGF, PDGFB, CXCL12, KIT, GCSF, CXCR4, PTPRC, TIE2, VEGFR1, VEGFR2, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind VEGF and 2, 3, 4, 5 or more of these targets are also encompassed by the invention. In specific embodiments, the antibody component of the MRD-containing antibody binds VEGF. In further embodiments, the antibody component of the MRD-containing antibody is bevacizumab. Multivalent and multispecific compositions (e.g., MRD-containing antibodies) that bind VEGF and 2, 3, 4, 5 or more of these targets are also encompassed by the invention. In specific embodiments, the antibody component of the MRD-containing antibody binds VEGF. In further embodiments, the antibody component of the MRD-containing antibody is bevacizumab.

In one embodiment, an MRD-containing antibody binds VEGF (i.e., VEGFA) and additionally binds an angiogenic target selected from: VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, EFNa1, EFNa2, ANG1, ANG2, IL-6, IL-8, IL-18, HGF, TIE2, PDGFA, P1GF, PDGFB, CXCL12, KIT, GCSF, CXCR4, PTPRC, TIE2, VEGFR1, VEGFR2, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind VEGF and 2, 3, 4, 5 or more of these targets are also encompassed by the invention. In specific embodiments, the antibody component of the MRD-containing antibody binds VEGF. In further embodiments, the antibody component of the MRD-containing antibody is bevacizumab. In additional embodiments, the antibody component of the MRD-containing antibody competes for VEGF binding with bevacizumab.

In one embodiment, an MRD-containing antibody binds TNF alpha and additionally binds a target selected from: Te38, IL-12, IL-12p40, IL-13, IL-15, IL-17, IL-18, IL-1beta, IL-23, MIF, PEG2, PGE4, VEGF, TNFSF11 (RANKL), TNFSF13B (BLYS), GP130, CD-22, and CTLA-4. In another embodiment, an MRD-containing antibody binds TNF alpha, IL6, and TNFSF13B (BLYS). Multivalent and multispecific compositions (e.g., MRD-containing antibodies) that bind TNF and 2, 3, 4, 5 or more of these targets are also encompassed by the invention. In specific embodiments, the antibody component of the MRD-containing antibody binds TNF. In further embodiments, the antibody component of the MRD-containing antibody is adalimumab, certolizumab, golimumab or AME-527. In additional embodiments, the antibody component of the MRD-containing antibody competes for TNF binding with adalimumab, certolizumab, golimumab or AME-527.

In one embodiment, an MRD-containing antibody binds IL1 alpha and IL1 beta. In another embodiment, an MRD-containing antibody binds IL1 beta and TNFSF11 (RANKL). In an additional embodiment, an MRD-containing antibody binds IL1 beta and a target selected from IL13, IL17A, TNF, VEGF, PGE2, VEGFR1, VEGFR2, TNFSF12 (TWEAK) and TNF. Multivalent and multispecific compositions (e.g., MRD-containing antibodies) that bind IL1 beta and at least 1, 2, 3, 4, 5 or more of these targets are also encompassed by the invention. In specific embodiments, the antibody component of the MRD-containing antibody binds IL1 beta. In further embodiments, the antibody component of the MRD-containing antibody is catumaxomab, Xoma052, canakinumab or ACZ885. In additional embodiments, the antibody component of the MRD-containing antibody competes for IL1 alpha or IL1 beta binding with catumaxomab, Xoma052, canakinumab or ACZ885.

In another embodiment, an MRD-containing antibody binds IL12. In a further embodiment, an MRD-containing antibody binds IL12 and additionally binds IL18 or TNFSF12 (TWEAK). Multivalent and multispecific compositions (e.g., MRD-containing antibodies) that bind CTLA-4 and at least 1, 2, 3, 4, 5 or more of these targets are also encompassed by the invention. In specific embodiments, the antibody component of the MRD-containing antibody binds CTLA-4. In further embodiments, the antibody component of the MRD-containing antibody is briakinumab or ustekinumab. In additional embodiments, the antibody component of the MRD-containing antibody competes for IL12 binding with briakinumab or ustekinumab.

In another embodiment, an MRD-containing antibody binds CTLA-4. In a further embodiment, an MRD-containing antibody binds CTLA4 and additionally binds PDL-1 or BTNO2. Multivalent and multispecific compositions (e.g., MRD-containing antibodies) that bind CTLA-4 and one or both of these targets are also encompassed by the invention. In specific embodiments, the antibody component of the MRD-containing antibody binds CTLA-4. In further embodiments, the antibody component of the MRD-containing antibody is tremelimumab or iplimumab. In additional embodiments, the antibody component of the MRD-containing antibody competes for CTLA-4 binding with tremelimumab or iplimumab.

In an additional embodiment, an MRD-containing binds IL13. In a further embodiment, an MRD-containing antibody binds IL13 and additionally binds a target selected from: IL1beta, IL4, IL9, IL13, IL25, a LHR agonist, MDC, MIF, PED2, SPRR2a, SPRR2b; TARC, TGF-beta and IL25. In another embodiment, an MRD-containing antibody binds IL13 and a target selected from IL5, ADAM8, a LHR (agonist), IL23p19 and IgE. Multivalent and multispecific compositions (e.g., MRD-containing antibodies) that bind IL13 and at least 1, 2, 3, 4, 5 or more of these targets are also encompassed by the invention. In specific embodiments, the antibody component of the MRD-containing antibody binds IL13. In further embodiments, the antibody component of the MRD-containing antibody is TNX-650, lebrikizumab or CAT354. In additional embodiments, the antibody component of the MRD-containing antibody competes for IL13 binding with TNX-650, lebrikizumab or CAT354.

In a further embodiment, an MRD-containing antibody binds RGM A. In a further embodiment, an MRD-containing antibody binds RGM A and additionally binds a target selected from: RGM B, MAG, NgR, NogoA, OMGp and CSPGs. Multivalent and multispecific compositions (e.g., MRD-containing antibodies) that bind RGM A and at least 1, 2, 3, 4, 5 or more of these targets are also encompassed by the invention. In specific embodiments, the antibody component of the MRD-containing antibody binds RGM A.

In another embodiment, an MRD-containing antibody binds CD38 and additionally binds a target selected from CD20, TNFRSF5 (CD40) ALK1, TNF, VEGF, VEGFA, VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, VEGFR1, VEGFR2 and CD138. Multivalent and multispecific compositions (e.g., MRD-containing antibodies) that bind CD38 and at least 1, 2 or all 3 of these targets are also encompassed by the invention. In specific embodiments, the antibody component of the MRD-containing antibody binds CD38. In further embodiments, the antibody component of the MRD-containing antibody binds MOR202 or daratumumab. In additional embodiments, the antibody component of the MRD-containing antibody competes for CD38 binding with MOR202 or daratumumab.

In some embodiments an MRD-containing antibody binds ErbB1 (EGFR) and additionally binds ErbB3. In specific embodiments, the antibody component of the MRD-containing antibody binds ErbB1. In additional embodiments, the antibody component of the MRD-containing antibody is ERBITUX®. In additional embodiments, the antibody component, MRD component, and/or MRD-containing antibody competes for ErbB1-binding with ERBITUX®. In another embodiment, the antibody component of the MRD-containing antibody is an ErbB1-binding antibody selected from: nimotuzumab, zalutumumab, matuzumab, panitumumab, MEDX-214, and ABX-EGF. In additional embodiments, the antibody component, MRD component, and/or MRD-containing antibody competes for ErbB1-binding with an antibody selected from: nimotuzumab, zalutumumab, matuzumab, panitumumab, MEDX-214, and ABX-EGF.

In one embodiment, an MRD-containing antibody binds ErbB2 and IGF1R. In another embodiment, an MRD-containing antibody binds ErbB2, Ang2, and IGF1R. In specific embodiments, the antibody component of the MRD-containing antibody binds ErbB2. In additional embodiments, the antibody component of the MRD-containing antibody is HuMax-Her2™ or trastuzumab-DM1. In further embodiments, the antibody component of the MRD-containing antibody is trastuzumab. In additional embodiments, the antibody component, MRD component, and/or MRD-containing antibody competes for ErbB2-binding with trastuzumab.

In one embodiment, an MRD-containing antibody binds ErbB2 and additionally binds a target selected from: ErbB3, EGFR, IGF1R, cMet, VEGF, RON (MST1R), DLL4, PLGF, CDCP1 (CD318), NRP1, TNFRSF10A (DR4) and TNFRSF10B (DR5). In another embodiment, an MRD-containing antibody binds ErbB2 and additionally binds a target selected from: CD2, CD3, CD4 and NKG2D. In an additional embodiment, an MRD-containing antibody binds ErbB2 and IGF1, IGF2 or IGF1,2. Multivalent and multispecific compositions (e.g., MRD-containing antibodies) that bind ErbB2 and additionally bind 1, 2, 3, 4, 5 or more of these targets are also encompassed by the invention. In specific embodiments, the antibody component of the MRD-containing antibody binds ErbB2. In additional embodiments, the antibody component of the MRD-containing antibody is HuMax-Her2™ or trastuzumab-DM1. In further embodiments, the antibody component of the MRD-containing antibody is trastuzumab. In additional embodiments, the antibody component, MRD component, and/or MRD-containing antibody competes for ErbB2-binding with trastuzumab.

In some embodiments an MRD-containing antibody binds ErbB2 and additionally binds ErbB3. In specific embodiments, the antibody component of the MRD-containing antibody binds ErbB2. In additional embodiments, the antibody component of the MRD-containing antibody is HuMax-Her2™ or trastuzumab-DM1. In further embodiments, the antibody component of the MRD-containing antibody is trastuzumab. In additional embodiments, the antibody component, MRD component, and/or MRD-containing antibody competes for ErbB2-binding with trastuzumab. In another embodiment, the antibody component of the MRD-containing antibody is an ErbB2-binding antibody selected from: MDX-210 (Medarex), tgDCC-E1A (Targeted Genetics), MGAH22 (MacroGenics), and pertuzumab (OMNITARG™). In additional embodiments, the antibody component, MRD component, and/or MRD-containing antibody competes for ErbB2-binding with an antibody selected from: MDX-210, tgDCC-E1A, MGAH22, and pertuzumab.

In some embodiments, an MRD-containing antibody binds ErbB2 and HER2/3. In further embodiments, an MRD-containing antibody binds ErbB2 and HER2/3 simultaneously.

Angiogenesis inhibitors targeting the vascular endothelial growth factor (VEGF) signaling pathways have been observed to provide at best transitory therapeutic benefits followed by restoration of tumor growth and progression due to an apparent ability of angiogenic tumors to adapt the presence of these inhibitors. Without being bound by theory, it is believed that the multivalent and multispecific properties of MRD-containing antibodies that bind an angiogenesis target provide these compounds with an ability to extend anti-angiogenic therapeutic benefits beyond those observed from for example, conventional monoclonal antibody therapies by binding multiple distinct angiogenesis related targets and thereby disrupting resistance mechanisms available to the angiogenic tumor.

In another embodiment, an MRD-containing antibody binds PDGFRA and additionally binds an target selected from: VEGFA, VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, EFNa1, EFNa2, ANG1, ANG2, IL6, IL8, IL18, IGF1, IGF2, IGF1,2, HGF, TIE2, PDGFA, PLGF, PDGFB, CXCL12, KIT, GCSF, CXCR4, PTPRC, TIE2, VEGFR1, VEGFR2, VEGFR3, EGFR, cMET, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, and PDGFRB. Multivalent and multispecific compositions (e.g., MRD-containing antibodies) that bind PDGFRA and binds at least 1, 2, 3, 4, 5 or more of these targets are also encompassed by the invention. In specific embodiments, the antibody component of the MRD-containing antibody binds PDGFRA. In further embodiments, the antibody component of the MRD-containing antibody is olaratumab. In further embodiments, the antibody component, MRD component, and/or MRD-containing antibody competes for PDGFRA binding with olaratumab. In further embodiments, the antibody component of the MRD-containing antibody is MEDI-575. In further embodiments, the antibody component, MRD component, and/or MRD-containing antibody competes for PDGFRA binding with MEDI-575.

In another embodiment, an MRD-containing antibody binds PDGFRB and additionally binds an target selected from: VEGFA, VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, EFNa1, EFNa2, ANG1, ANG2, IL6, IL8, IL18, IGF1, IGF2, IGF1,2, HGF, TIE2, PDGFA, PLGF, PDGFB, CXCL12, KIT, GCSF, CXCR4, PTPRC, TIE2, VEGFR1, VEGFR2, VEGFR3, EGFR, cMET, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, and PDGFRA. Multivalent and multispecific compositions (e.g., MRD-containing antibodies) that bind PDGFRB and also bind at least 1, 2, 3, 4, 5 or more of these targets are also encompassed by the invention. In specific embodiments, the antibody component of the MRD-containing antibody binds PDGFRB.

In another embodiment, an MRD-containing antibody binds VEGFR1 and additionally binds an angiogenic target selected from: VEGF (i.e., VEGFA), VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, EFNa1, EFNa2, ANG1, ANG2, IL6, IL8, IL18, HGF, PDGFA, PLGF, PDGFB, CXCL12, KIT, GCSF, CXCR4, PTPRC, TIE2, VEGFR2, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind VEGFR1 and additionally bind 1, 2, 3, 4, 5 or more of these targets are also encompassed by the invention. In specific embodiments, the antibody component of the MRD-containing antibody binds VEGFR1. In further embodiments, the antibody component of the MRD-containing antibody is IMC-18F1. In additional embodiments, the antibody component, MRD component, and/or MRD-containing antibody competes for VEGFR1 binding with IMC-18F1.

In another embodiment, an MRD-containing antibody binds VEGFR2 and additionally binds a target selected from: VEGF (i.e., VEGFA), VEGFB, FGF1, FGF2, FGF4, FGF7, FGF8b, FGF19, FGFR1 (e.g., FGFR1-IIIC), FGFR2 (e.g., FGFR2-IIIa, FGFR2-IIIb, and FGFR2-IIIc), FGFR3, TNFSF2 (TNFa), FGFR3, NRP1, ROBO4, CD30, CD33, CD55 CD80, KIT, CXCL12, Notch1EFNa1, EFNa2, ANG1, ANG2, IL6, IL8, 1L18, HGF, PDGFA, PLGF, PDGFB, CXCL12, KIT, GCSF, CXCR4, PTPRC, TIE2, VEGFR1, VEGFR3, Notch 1, DLL4, EGFL7, α2β1 integrin, α4β1 integrin, α5β1 integrin, αvβ3 integrin, TGFb, MMP2, MMP7, MMP9, MMP12, PLAU, VCAM1, PDGFRA, and PDGFRB. Multivalent and multispecific compositions (e.g., MRD-containing antibodies) that bind VEGFR2 and additionally bind 1, 2, 3, 4, 5 or more of these targets are also encompassed by the invention. In specific embodiments, the antibody component of the MRD-containing antibody binds VEGFR2. In further embodiments, the antibody component of the MRD-containing antibody is IMC-1C11 or DC101. In additional embodiments, the antibody component, MRD component, and/or MRD-containing antibody competes for VEGFR2 binding with IMC-1C11 or DC101.

In another embodiment, an MRD-containing antibody binds VEGFR2 and additionally binds ANG2 or TIE2. In specific embodiments, the antibody component of the MRD-containing antibody binds VEGFR2. In further embodiments, the antibody component of the MRD-containing antibody is IMC-1C11, DC101 or TTAC-0001. In additional embodiments, the antibody component, MRD component, and/or MRD-containing antibody competes for VEGFR2 binding with IMC-1C11, DC101 or TTAC-0001. In further embodiments, the TIE2 binding component comprises a fragment of ANG2 that binds TIE2. In particular embodiments, the TIE2 binding component comprises amino acids 283-449 of the human ANG2 disclosed in NCBI Ref Seq. No. NP_001138.1.

In another embodiment, an MRD-containing antibody binds DLL4 and additionally binds a target selected from: EGFR, PLGF, VEGFR1, VEGFR2 and VEGF. Multivalent and multispecific compositions (e.g., MRD-containing antibodies) that bind DLL4 and at least 1, 2, 3, 4, 5 or more of these targets are also encompassed by the invention. In further embodiments, the antibody component of the MRD-containing antibody is REGN421. In additional embodiments, the antibody component, MRD component, and/or MRD-containing antibody competes for DLL4 binding with REGN421.

In additional embodiments, an MRD-containing antibody binds to an anti-angiogenic and a metastatic or invasive cancer target. In one embodiment, an MRD-containing antibody binds to an angiogenic target and also binds a metastatic or invasive cancer target selected from: CXCL12, CXCR4 (e.g., CXCR4b), CCR7 (e.g., CXCR7b), CD44 (e.g., CD44v3 and CD44v6), α2β1 integrin, α4β1 integrin, α5β1 integrin, αvβ1 integrin, αvβ3 integrin, TGFb, αvβ5 integrin, α9β1 integrin, α6β4 integrin, αMβ2 integrin, PD-1, HGF, cMET, MMP2, MMP-7, MMP-9, MMP-12, VEGFA, VEGFB, and IGF1. Multivalent and multispecific compositions (e.g., MRD-containing antibodies) that bind an angiogenic target and also bind 2, 3, 4, 5 or more of these metastatic or invasive cancer targets are also encompassed by the invention. In specific embodiments, the antibody component of the MRD-containing antibody binds VEGF. In further embodiments, the antibody component of the MRD-containing antibody is bevacizumab. In additional embodiments, the antibody component, MRD component, and/or MRD-containing antibody competes for VEGF binding with bevacizumab.

In one embodiment, an MRD-containing antibody binds to 2 or more targets associated with distinct cell signaling pathways. In additional embodiments, an MRD-containing antibody binds to 2 or more targets associated with redundant, overlapping or cross-talking signaling pathways. For example, in one embodiment, an MRD-containing antibody binds to 2 or more targets associated with PI3K/AKT/mTOR signaling (e.g., ErbB2, EGFR, IGF1R, Notch, FGFR1 (e.g., FGFR1-IIIC), FGFR2 (e.g., FGFR2-IIIa, FGFR2-IIIb, and FGFR2-IIIb), FGFR3, FGFR4, GPCR, and/or c-MET). In some embodiments, the multivalent and monovalent multispecific composition (e.g., MRD-containing antibody) binds 2, 3, 4, 5 or more of these targets.

In another embodiment, an MRD-containing antibody binds to 2 or more targets associated with receptor tyrosine Raf/MEK/MAPK signaling (e.g., VEGFR1, VEGFR2, VEGFR3, FGFR1 (e.g., FGFR1-IIIC), FGFR2 (e.g., FGFR2-IIIa, FGFR2-IIIb, and FGFR2-IIIb), FGFR3, FGFR4, CD28, RET, cMET, EGFR, ErbB2, Notch, Notch1, Notch3, Notch4, DLL1, DLL4, Jagged, Jagged1, Jagged2, and Jagged3. In some embodiments, the multivalent and multispecific compositions (e.g., MRD-containing antibodies) bind 1, 2, 3, 4, 5 or more of these targets.

In another embodiment, an MRD-containing antibody binds to 2 or more targets associated with SMAD signaling (e.g., Notch, TGFβ, TGFβR1, TGFβR2, and a BMP). In some embodiments, the multivalent and multispecific compositions (e.g., MRD-containing antibodies) bind 2, 3, 4, 5 or more of these targets.

In another embodiment, an MRD-containing antibody binds to 2 or more targets associated with JAK/STAT signaling (e.g., IFNgR1, IFNgR3, IFNG, IFN-AR2, IFN-AR1, IFN alpha, IFN beta, IL6a receptor (GP130), IL6, IL12RB1, IL12, and EGFR). Thus, the invention encompasses an MRD-containing antibody that binds to 2 or more targets selected from WNT1, WNT2, WNT2b, WNT3, WNT3A, WNT4, WNT5A, WNT5B, WNT6, WNT7A, WNT7B, WNT8A, WNT8B, WNT9A, WNT9B, WNT10A, WNT10B, WNT11, WNT16, FZD1, FZD2, FZD4, FZD5, FZD6, FZD7, FZD8, Notch, Notch1, Notch3, Notch4, DLL1, DLL4, Jagged, Jagged1, Jagged2, and Jagged3. In some embodiments, the multivalent and multispecific compositions (e.g., MRD-containing antibodies) bind 2, 3, 4, 5 or more of these targets.

In another embodiment, an MRD-containing antibody binds to 2 or more targets associated with NFkB signaling (e.g., BCR, TCR, IL1R, ILL FZD1, FZD2, FZD4, FZD5, FZD6, FZD7, FZD8, Notch, Notch1, Notch3, Notch4, DLL4, Jagged, Jagged1, Jagged2, Jagged3, TNFSF1 (TNFb, LTa), TNFRSF1A (TNFR1, p55, p60), TNFRSF1B (TNFR2), TNFSF6 (Fas Ligand), TNFRSF6 (Fas, CD95), TNFRSF6B (DcR3), TNFSF7 (CD27 Ligand, CD70), TNFRSF7 (CD27), TNFSF8 (CD30 Ligand), TNFRSF8 (CD30), TNFSF11 (RANKL), TNFRSF11A (RANK), TNFSF12 (TWEAK), TNFRSF12 (TWEAKR), TNFSF13 (APRIL), TNFSF13B (BLYS), TNFRSF13B (TACI), TNFRSF13C (BAFFR), TNFSF15 (TL1A), TNFRSF17 (BCMA), TNFRSF19L (RELT), TNFRSF19 (TROY), TNFRSF21 (DR6), TNFRSF25 (DR3), TNFSF5 (CD40 Ligand), TNFRSF5 (CD40), TNFSF2 (TNFa), TNFSF3 (LTb), TNFRSF3 (LTBR), TNFSF14 (LIGHT, HVEM Ligand), TNFRSF14 (HVEM), TNFSF18 (GITR Ligand), TNFRSF18 (GITR), TNFSF4 (OX40 Ligand), TNFRSF4 (OX40), TNFSF9 (41BB Ligand), TNFRSF9 (41BB), a BMP, NGF, and TGF alpha). In some embodiments, the multivalent and multispecific compositions (e.g., MRD-containing antibodies) bind 2, 3, 4, 5 or more of these targets.

In another embodiment, an MRD-containing antibody binds to 2 or more targets associated with cell proliferation (e.g., FGF1, FGF2, FGF7, FGF4, FGF10, FGF18b, FGF19, FGF23, FGFR1 (e.g., FGFR1-IIIC), FGFR2 (e.g., FGFRIIIB and FGFR-IIIC), FGFR3, FGFR4, TCR, TNFRSF5 (CD40), TLR1, TLR2, TLR3, TLR 4, TLR5, and TLR6). In some embodiments, the multivalent and multi-specific compositions (e.g., MRD-containing antibodies) bind 2, 3, 4, 5 or more of these targets.

In another embodiment, an MRD-containing antibody binds to 2 or more targets associated with toll-like receptor signaling (e.g., TLR1, TLR2, TLR3, TLR 4, TLR5, and TLR6).

In another embodiment, an MRD-containing antibody binds to 2 or more targets associated with B cell signaling (e.g., mIg, Igα/Igβ (CD79a/CD79b) heterodimers (α/β), CD19, CD20, CD21, CD22, CD23, CD27, CD30, CD46, CD80, CD86, ICOSL (B7-H2), HLA-DR (CD74), PD1, PDL1, TNFRSF1A (TNFR1, p55, p60), TNFRSF1B (TNFR2), TNFRSF13B (TACI), TNFRSF13C (BAFFR), TNFRSF17 (BCMA), BTLA, TNFRSF5 (CD40), TLR4, TNFRSF14 (HVEM), Fc gamma RIIB, IL4R and CRAC. In a particular embodiment, the MRD-containing antibody binds to CD19 and CD20. In an additional embodiment, the MRD-containing antibody binds CD19, CD20, and CD22. In some embodiments, the multivalent and monovalent multispecific composition (e.g., MRD-containing antibodies) binds 2, 3, 4, 5 or more of these targets.

In a further embodiment, an MRD-containing antibody binds to 1 or more B cell surface markers selected from: CD10, CD24, CD37, CD53, CD72, CD75, CD77, CD79a, CD79b, CD81, CD82, CD83, CD84 (SLAM5) and CD85. In a further embodiment, an MRD-containing antibody binds to 1 or more B cell surface markers selected from: CD10, CD24, CD37, CD53, CD72, CD75, CD77, CD79a, CD79b, CD81, CD82, CD83, CD84 (SLAM5) and CD85. In some embodiments, the multivalent and multispecific compositions (e.g., MRD-containing antibodies) bind 2, 3, 4, 5 or more of these B cell surface markers.

In additional embodiments, an MRD-containing antibody binds CD19 and a target selected from: CD20, CD22, CD30, CD33, TNFRSF5 (CD40), CD52, CD74, CD80, CD138, VEGFR1, VEGFR2, EGFR, TNFRSF10A (DR4), TNFRSF10B (DR5), TNF, NGF, VEGF, IGF1,2, IGF2, IGF1 and TNFSF11 (RANKL). In additional embodiments, an MRD-containing antibody binds CD20 and a target selected from: CD3, CD4 and NKG2D. Multivalent and multispecific compositions (e.g., MRD-containing antibodies) that bind CD19 and also bind at least 2, 3, 4, 5 or more of these targets are also encompassed by the invention. In specific embodiments, the antibody component of the MRD-containing antibody binds CD19. In further embodiments, the antibody component of the MRD-containing antibody is MDX-1342, SGN-CD19A, XMAB®5574, SGN-19A, ASG-5ME or MEDI-551. In additional embodiments, the antibody component, MRD component, and/or MRD-containing antibody competes for CD19 binding with MDX-1342, SGN-CD19A, XMAB®5574, SGN-19A, ASG-5ME or MEDI-551.

In additional embodiments, an MRD-containing antibody binds CD22 and a target selected from: CD19, CD20, CD23, CD30, CD33, TNFRSF5 (CD40), CD52, CD74, CD80, TNFRSF10A (DR4), TNFRSF10B (DR5), VEGF, TNF and NGF. In additional embodiments, an MRD-containing antibody binds CD22 and a target selected from: CD3, CD4 and NKG2D. Multivalent and multispecific compositions (e.g., MRD-containing antibodies) that bind CD22 and also bind 2, 3, 4, 5 or more of these targets are also encompassed by the invention. In specific embodiments, the antibody component of the MRD-containing antibody binds CD22. In further embodiments, the antibody component of the MRD-containing antibody is epratuzumab or inotuzumab. In additional embodiments, the antibody component, MRD component, and/or MRD-containing antibody competes for CD22 binding with epratuzumab or inotuzumab.

In additional embodiments, the antibody component of the MRD-containing antibody is moxetumomab (CAT-8015, Cambridge Antibody Technologies). In additional embodiments, the antibody component, MRD component, and/or MRD-containing antibody competes for CD22 binding with moxetumomab.

In additional embodiments, an MRD-containing antibody binds TNFRSF5 (CD40) and a target selected from: BCMA, TNFSF11 (RANKL), VEGFR1, VEGFR2, TNFRSF10A (DR4), TNFRSF10B (DR5), CD22, CD30, CD38, CD56 (NCAM), CD70, CD80, CD138, IL6, IGF1, IGF2, IGF1,2, BLyS, APRIL and NGF. In additional embodiments, an MRD-containing antibody binds CD40 and a target selected from: CD3, CD4 and NKG2D. Multivalent and multispecific compositions (e.g., MRD-containing antibodies) that bind CD40 and also bind 2, 3, 4, 5 or more of these targets are also encompassed by the invention. In specific embodiments, the antibody component of the MRD-containing antibody binds CD40. In further embodiments, the antibody component of the MRD-containing antibody is CP870893, dacetuzumab, ANTOVA®, lucatumumab, XMAB®5485 or teneliximab. In additional embodiments, the antibody component, MRD component, and/or MRD-containing antibody competes for CD40 binding with CP870893, dacetuzumab, ANTOVA®, lucatumumab, XMAB®5485 or teneliximab.

In some embodiments, an MRD-containing antibody binds CD33 and a target selected from: FLT3, CD44, TNFRSF10A (DR4), TNFRSF10B (DR5), CD80, MGC, VEGFR1, VEGFR2, IL1, IL6, TNF and VEGF. Multivalent and multispecific compositions (e.g., MRD-containing antibodies) that bind TNFRSF10B and also bind at least 2, 3, 4, 5 or more of these targets are also encompassed by the invention. In specific embodiments, the antibody component of the MRD-containing antibody binds CD33. In further embodiments, the antibody component of the MRD-containing antibody is gemtuzumab or lintuzumab. In additional embodiments the antibody component, MRD component, and/or MRD-containing antibody competes for CD33 binding with gemtuzumab or lintuzumab.

In another embodiment, an MRD-containing antibody binds to 2 or more targets associated with antigen presentation cell signaling (e.g., mIg, Igα/Igβ (CD79a/CD79b) heterodimers (α/β), CD19, CD20, CD21, CD22, CD23, CD27, CD28, CD30, CD30L, TNFSF14 (LIGHT, HVEM Ligand), CD70, ICOS, ICOSL (B7-H2), CTLA4, PD-1, PDL1 (B7-H1), B7-H4, B7-H3, PDL2 (B7-DC), BTLA, CD46, CD80 (B7-1), CD86 (B7-2), HLA-DR, CD74, PD1, TNFRSF4 (OX40), TNFRSF9 (41BB), TNFSF4 (OX40 Ligand), TNFSF9 (41BB Ligand), TNFRSF9 (41BB), TNFRSF1A (TNFR1, p55, p60), TNFRSF1B (TNFR2), TNFRSF13B (TACI), TNFRSF13C (BAFFR), TNFRSF17 (BCMA), BTLA, TNFRSF18 (GITR), MHC-1, TNFRSF5 (CD40), TLR4, TNFRSF14 (HVEM), Fcgamma RIIB, IL4R and CRAC). In some embodiments, the multivalent and multispecific compositions (e.g., MRD-containing antibodies) bind 2, 3, 4, 5 or more of these targets.

In another embodiment, an MRD-containing antibody binds to 2 or more targets associated with T cell receptor signaling (e.g., CD3, CD4, CD27, CD28, CD70, IL2R, LFA-1, C4, ICOS, CTLA-4, CD45, CD80, CD86, PG-1, TIM1, TIM2, TIM3, TIM4, galectin 9, TNFRSF1A (TNFR1, p55, p60), TNFRSF1B (TNFR2), TNFRSF21 (DR6), TNFRSF6 (Fas, CD95), TNFRSF25 (DR3), TNFRSF14 (HVEM), TNFSF18, TNFSF18 (GITR), TNFRSF4 (OX40), TNFSF4 (OX40 Ligand), PD1, PDL1, CTLA4, TNFSF9 (41BB Ligand), TNFRSF9 (41BB), TNFSF14 (LIGHT, HVEM Ligand), TNFSF5 (CD40 Ligand), BTLA, and CRAC). In some embodiments, the multivalent and multispecific compositions (e.g., MRD-containing antibodies) bind 2, 3, 4, 5 or more of these targets.

In additional embodiments, an MRD-containing antibody binds to a cell surface tumor antigen and a second target that is associated with an escape pathway for resisting chemotherapy. In some embodiments, the cell surface tumor antigen is a member selected from EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC.

In further embodiments, an MRD-containing antibody binds P-glycoprotein (encoded by MDR1) and a cell surface antigen. In particular embodiments, the cell surface antigen is a tumor antigen. In further embodiments, the cell surface tumor antigen is a member selected from EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC. In particular embodiments the MRD-containing antibody competes for CD30 binding with SGN-35 (brentuximab). In additional particular embodiments the MRD-containing antibody competes for ErbB2 binding with trastuzumab.

In further embodiments, an MRD-containing antibody binds MRP (Multidrug-Resistance associated Protein) and a cell surface antigen. In particular embodiments, the cell surface antigen is a tumor antigen. In further embodiments, the cell surface tumor antigen is a member selected from EGFR, ErbB2, ErbB3, ErbB4, FGFR, VEGFR1, VEGFR2, VEGFR3, PDGFR1, CD3, CD19, CD20, CD22, CD25, CD30, CD33, CD37, CD56, CD70, CD133, CD138, FOLR1, IGF1-R, Cripto, SLC44A4 and GCC. In particular embodiments the MRD-containing antibody competes for CD30 binding with SGN-35 (brentuximab). In additional particular embodiments the MRD-containing antibody competes for ErbB2 binding with trastuzumab.

In another embodiment an MRD-containing antibody binds to a therapeutic target and a second target that is associated with an escape pathway for resisting the therapeutic effect resulting from targeting the therapeutic target. For example, in one embodiment, an MRD-containing antibody binds to EGFR and a target selected from MDR1, cMET, Notch, Notch1, Notch3, Notch4, DLL1, DLL4, Jagged, Jagged1, Jagged2, and Jagged3. In some embodiments, the multivalent and monovalent multispecific composition (e.g., MRD-containing antibodies) binds 2, 3, 4, 5 or more of these targets.

In specific embodiments, the MRD-containing antibody targets ErbB2 and an angiogenic factor. In specific embodiments, the MRD-containing antibody targets ErbB2 and IGF1R. In another embodiment, the antibody targets ErbB2 and at least one MRD targets an angiogenic factor and/or IGF1R. In one embodiment, an antibody that binds to the same ErbB2 epitope as trastuzumab is operably linked to at least one MRD that targets an angiogenic factor and/or IGF1R. In an additional embodiment, an antibody that competitively inhibits trastuzumab binding is operably linked to at least one MRD that targets an angiogenic factor and/or IGF1R. In additional embodiments, an antibody that comprises the sequences of SEQ ID NOs:59-64 is operably linked to at least one MRD that targets an angiogenic factor and/or IGF1R. In additional embodiments, the trastuzumab antibody is operably linked to at least one MRD that targets an angiogenic factor and/or IGF1R.

In some embodiments, an antibody that binds to ErbB2 is operably linked to an MRD that targets Ang2. In some embodiments, the antibody that binds to ErbB2 is linked to an Ang2 binding MRD that binds to the same Ang2 epitope as an MRD comprising the sequence of MGAQTNFMPM-DNDELLLYEQFILQQGLE SEQ ID NO:8. In some embodiments, the antibody that binds to ErbB2 is linked to an Ang2 binding MRD that competitively inhibits an MRD comprising the sequence of SEQ ID NO:8. In some embodiments, the antibody that binds to ErbB2 is linked to an MRD comprising the sequence of SEQ ID NO:8.

In some embodiments, at least one Ang2 binding MRD is operably linked to the C-terminus of the heavy chain of an antibody that binds to ErbB2. In some embodiments, at least one Ang2 binding MRD is operably linked to the N-terminus of the heavy chain of an antibody that binds to ErbB2. In some embodiments, at least one Ang2 binding MRD is operably linked to the C-terminus of the light chain of an antibody that binds to ErbB2. In some embodiments, at least one Ang2 binding MRD is operably linked to the N-terminus of the light chain of an antibody that binds to ErbB2.

In some embodiments, at least one Ang2 binding MRD is operably linked directly to an antibody that binds to ErbB2. In additional embodiments, at least one Ang2 binding MRD is operably linked to an antibody that binds to ErbB2 via a linker.

In some embodiments, an antibody that binds to ErbB2 is operably linked to an MRD that targets IGF1R. In some embodiments, the antibody that binds to ErbB2 is linked to an IGF1R binding MRD that binds to the same IGF1R epitope as an MRD comprising the sequence of SEQ ID NO:14. In some embodiments, the antibody that binds to ErbB2 is linked to an IGF1R binding MRD that competitively inhibits an MRD comprising the sequence of SEQ ID NO:14. In some embodiments, the antibody that binds to ErbB2 is linked to an MRD comprising the sequence of SEQ ID NO:14. In some embodiments, the antibody that binds ErbB2 is linked to an MRD encoding the sequence SLFVPRPERK (SEQ ID NO:103). In some embodiments, the antibody that binds ErbB2 is linked to an MRD encoding the sequence ESDVLHFTST (SEQ ID NO:104). In some embodiments, the antibody that binds ErbB2 is linked to an MRD encoding the sequence LRKYADGTL (SEQ ID NO:105).

In some embodiments, at least one IGF1R binding MRD is operably linked to the C-terminus of the heavy chain of an antibody that binds to ErbB2. In some embodiments, at least one IGF1R binding MRD is operably linked to the N-terminus of the heavy chain of an antibody that binds to ErbB2. In some embodiments, at least one IGF1R binding MRD is operably linked to the C-terminus of the light chain of an antibody that binds to ErbB2. In some embodiments, at least one IGF1R binding MRD is operably linked to the N-terminus of the light chain of an antibody that binds to ErbB2.

In some embodiments, at least one IGF1R binding MRD is operably linked directly to an antibody that binds to ErbB2. In additional embodiments, at least one IGF1R binding MRD is operably linked to an antibody that binds to ErbB2 via a linker.

In some embodiments, an MRD-containing antibody targets ErbB2 and HER2/3. In some embodiments, an MRD-containing antibody can bind to ErbB2 and HER2/3 simultaneously. In some embodiments, an antibody that binds to ErbB2 is operably linked to an MRD that targets HER2/3. In additional embodiments, at least one HER2/3-binding MRD is operably linked to the C-terminus of the heavy chain of an antibody that binds to ErbB2. In further embodiments, at least one HER2/3-binding MRD is operably linked to the N-terminus of the heavy chain of an antibody that binds to ErbB2. In additional embodiments, at least one HER2/3-binding MRD is operably linked to the C-terminus of the light chain of an antibody that binds to ErbB2. In additional embodiments, at least one HER2/3-binding MRD is operably linked to the N-terminus of the light chain of an antibody that binds to ErbB2.

In some embodiments, at least one HER2/3-binding MRD is operably linked directly to an antibody that binds to ErbB2. In additional embodiments, at least one HER2/3-binding MRD is operably linked to an antibody that binds to ErbB2 via a linker.

In some embodiments, an MRD-containing antibody targets ErbB2 and HER2/3. In some embodiments, an MRD-containing antibody can bind to ErbB2 and HER2/3 simultaneously. In some embodiments, an antibody that binds to HER2/3 is operably linked to an MRD that targets ErbB2. In additional embodiments, at least one ErbB2-binding MRD is operably linked to the C-terminus of the heavy chain of an antibody that binds to HER2/3. In further embodiments, at least one ErbB2-binding MRD is operably linked to the N-terminus of the heavy chain of an antibody that binds to HER2/3. In additional embodiments, at least one ErbB2-binding MRD is operably linked to the C-terminus of the light chain of an antibody that binds to HER2/3. In additional embodiments, at least one ErbB2-binding MRD is operably linked to the N-terminus of the light chain of an antibody that binds to HER2/3.

In some embodiments, at least one ErbB2-binding MRD is operably linked directly to an antibody that binds to HER2/3. In additional embodiments, at least one ErbB2-binding MRD is operably linked to an antibody that binds to HER2/3 via a linker.

In some embodiments, the MRD-containing antibody targets ErbB2, Ang2, and IGF1R. In some embodiments, the MRD-containing antibody comprises an antibody that targets ErbB2, an MRD that targets Ang2, and an MRD that targets IGF1R. In some embodiments, the Ang2 and IGF1R MRDs are attached to the same location on the anti-ErbB2 antibody. In some embodiments, the Ang2 and IGF1R MRDs are attached to different locations on the anti-ErbB2 antibody. In some embodiments, the Ang2 and IGF1R MRDs are on the light chain of the anti-ErbB2 antibody. In some embodiments, the Ang2 and IGF1R MRDs are on the heavy chain of the anti-ErbB2 antibody. In some embodiments, the Ang2 MRD is on the light chain of the ErbB2 antibody, and the IGF1R MRD is on the heavy chain of the anti-ErbB2 antibody. In some embodiments, the Ang2 MRD is on the heavy chain of the ErbB2 antibody, and the IGF1R MRD is on the light chain of the anti-ErbB2 antibody. In some embodiments, the Ang2 MRD is on the N-terminus of the heavy chain of the ErbB2 antibody, and the IGF1R MRD is on the C-terminus of the light chain of the anti-ErbB2 antibody. In some embodiments, the IGF1R MRD is on the N-terminus of the heavy chain of the ErbB2 antibody, and the Ang2 MRD is on the C-terminus of the light chain of the anti-ErbB2 antibody. Multivalent and multispecific compositions (e.g., MRD-containing antibodies) comprising an antibody that targets Ang2, an MRD that targets ErbB2, and an MRD that targets IGF1R; and multivalent and multispecific compositions (e.g., MRD-containing antibodies) comprising an antibody that targets IGF1R, an MRD that targets ErbB2, and an MRD that targets Ang2 are also encompassed by the invention.

In some embodiments, the MRD-containing antibody targets ErbB2, Ang2, and HER2/3. In some embodiments, the MRD-containing antibody comprises an antibody that targets ErbB2, an MRD that targets Ang2, and an MRD that targets HER2/3. In some embodiments, the Ang2 and HER2/3 MRDs are attached to the same location on the anti-ErbB2 antibody. In some embodiments, the Ang2 and HER2/3 MRDs are attached to different locations on the anti-ErbB2 antibody. In some embodiments, the Ang2 and HER2/3 MRDs are on the light chain of the anti-ErbB2 antibody. In some embodiments, the Ang2 and HER2/3 MRDs are on the heavy chain of the anti-ErbB2 antibody. In some embodiments, the Ang2 MRD is on the light chain of the ErbB2 antibody, and the HER2/3 MRD is on the heavy chain of the anti-ErbB2 antibody. In some embodiments, the Ang2 MRD is on the heavy chain of the ErbB2 antibody, and the HER2/3 MRD is on the light chain of the anti-ErbB2 antibody. In some embodiments, the Ang2 MRD is on the N-terminus of the heavy chain of the ErbB2 antibody, and the HER2/3 MRD is on the C-terminus of the light chain of the anti-ErbB2 antibody. In some embodiments, the HER2/3 MRD is on the N-terminus of the heavy chain of the ErbB2 antibody, and the Ang2 MRD is on the C-terminus of the light chain of the anti-ErbB2 antibody. Multivalent and multispecific compositions (e.g., MRD-containing antibodies) comprising an antibody that targets HER2/3, an MRD that targets ErbB2, and an MRD that targets Ang2; and multivalent and multispecific compositions (e.g., MRD-containing antibodies) comprising an antibody that targets Ang2, an MRD that targets ErbB2, and an MRD that targets HER2/3 are also encompassed by the invention.

In some embodiments, the MRD-containing antibody targets ErbB2, HER2/3, and IGF1R. In some embodiments, the MRD-containing antibody comprises an antibody that targets ErbB2, an MRD that targets HER2/3, and an MRD that targets IGF1R. In some embodiments, the HER2/3 and IGF1R MRDs are attached to the same location on the anti-ErbB2 antibody. In some embodiments, the HER2/3 and IGF1R MRDs are attached to different locations on the anti-ErbB2 antibody. In some embodiments, the HER2/3 and IGF1R MRDs are on the light chain of the anti-ErbB2 antibody. In some embodiments, the HER2/3 and IGF1R MRDs are on the heavy chain of the anti-ErbB2 antibody. In some embodiments, the HER2/3 MRD is on the light chain of the ErbB2 antibody, and the IGF1R MRD is on the heavy chain of the anti-ErbB2 antibody. In some embodiments, the HER2/3 MRD is on the heavy chain of the ErbB2 antibody, and the IGF1R MRD is on the light chain of the anti-ErbB2 antibody. In some embodiments, the HER2/3 MRD is on the N-terminus of the heavy chain of the ErbB2 antibody, and the IGF1R MRD is on the C-terminus of the light chain of the anti-ErbB2 antibody. In some embodiments, the IGF1R MRD is on the N-terminus of the heavy chain of the ErbB2 antibody, and the HER2/3 MRD is on the C-terminus of the light chain of the anti-ErbB2 antibody. Multivalent and multispecific compositions (e.g., MRD-containing antibodies) comprising an antibody that targets HER2/3, an MRD that targets ErbB2, and an MRD that targets IGF1R; and multivalent and multispecific compositions (e.g., MRD-containing antibodies) comprising an antibody that targets IGF1R, an MRD that targets ErbB2, and an MRD that targets HER2/3 are also encompassed by the invention.

In some embodiments, the MRD-containing antibody targets ErbB2, Ang2, HER2/3, and IGF1R. In some embodiments, the MRD-containing antibody comprises an antibody that targets ErbB2, an MRD that targets Ang2, an MRD that targets HER2/3, and an MRD that targets IGF1R. In some embodiments, the Ang2, HER2/3, and IGF1R MRDs are attached to the same chain of the anti-ErbB2 antibody. In some embodiments, the Ang2, HER2/3, and IGF1R MRDs are attached to different chains of the anti-ErbB2 antibody. In some embodiments, the Ang2, HER2/3, and IGF1R MRDs are on the light chain of the anti-ErbB2 antibody. In some embodiments, the Ang2, HER2/3, and IGF1R MRDs are on the heavy chain of the anti-ErbB2 antibody. In some embodiments, the Ang2, HER2/3, and IGF1R MRDs are attached to the same terminus of the anti-ErbB2 antibody. In some embodiments, the Ang2, HER2/3, and IGF1R MRDs are attached to different termini of the anti-ErbB2 antibody. Multivalent and multispecific compositions (e.g., MRD-containing antibodies) comprising: an antibody that targets HER2/3, an MRD that targets ErbB2, an MRD that targets Ang2, and an MRD that targets IGF1R; multivalent and multispecific compositions (e.g., MRD-containing antibodies) comprising an antibody that targets Ang2, an MRD that targets ErbB2, an MRD that targets HER2/3, and an MRD that targets IGF1R; and multivalent and multispecific compositions (e.g., MRD-containing antibodies) comprising an antibody that targets IGF1R, an MRD that targets ErbB2, an MRD that targets HER2/3, and an MRD that targets Ang2 are also encompassed by the invention.

In some embodiments, the anti-ErbB2 antibody operably linked to an Ang2 binding MRD binds to both ErbB2 and Ang2 simultaneously. In some embodiments, the anti-ErbB2 antibody operably linked to an IGF1R binding MRD binds to both ErbB2 and IGF1R simultaneously. In some embodiments, the anti-ErbB2 antibody operably linked to a HER2/3 binding MRD binds to both ErbB2 and HER2/3 simultaneously. In some embodiments, the anti-ErbB2 antibody operably linked to an Ang2 MRD, an IGF1R MRD, and/or a HER2/3 MRD binds to ErbB2, Ang2, IGF1R, and/or HER2/3 simultaneously. In some embodiments, the anti-ErbB2 antibody operably linked to an Ang2, IGF1R and/or HER2/3 binding MRD(s) exhibits ADCC activity. In additional embodiments, the anti-ErbB2 antibody operably linked to an Ang2, IGF1R, and/or HER2/3 binding MRD(s) down-regulates Akt signaling. In additional embodiments, the anti-ErbB2 antibody operably linked to an Ang2 binding MRD inhibits Ang2 binding to TIE2. In additional embodiments, the anti-ErbB2 antibody operably linked to an IGF1R binding MRD(s) down-regulates IGF1R signaling. In additional embodiments, the anti-ErbB2 antibody operably linked to an Ang2, IGF1R and/or HER2/3 binding MRD(s) inhibits cell proliferation. In additional embodiments, the anti-ErbB2 antibody operably linked to an Ang2, IGF1R, and/or HER2/3 binding MRD(s) inhibits tumor growth.

In specific embodiments, the MRD-containing antibody targets VEGF and an angiogenic factor. In specific embodiments, the MRD-containing antibody targets VEGF and IGF1R. In another embodiment, the antibody targets VEGF and at least one MRD targets an angiogenic factor and/or IGF1R. In one embodiment, an antibody that binds to the same VEGF epitope as bevacizumab is operably linked to at least one MRD that targets an angiogenic factor and/or IGF1R. In an additional embodiment, an antibody that competitively inhibits bevacizumab binding is operably linked to at least one MRD that targets an angiogenic factor and/or IGF1R. In additional embodiments, an antibody that comprises the sequences of SEQ ID NOs:78-79 is operably linked to at least one MRD that targets an angiogenic factor and/or IGF1R. In additional embodiments, the bevacizumab antibody is operably linked to at least one MRD that targets an angiogenic factor and/or IGF1R.

In some embodiments, an antibody that binds to VEGF is operably linked to an MRD that targets Ang2. In some embodiments, the antibody that binds to VEGF is linked to an Ang2 binding MRD that binds to the same Ang2 epitope as an MRD comprising the sequence of SEQ ID NO:8. In some embodiments, the antibody that binds to VEGF is linked to an Ang2 binding MRD that competitively inhibits an MRD comprising the sequence of SEQ ID NO:8. In some embodiments, the antibody that binds to VEGF is linked to an MRD comprising the sequence of SEQ ID NO:8.

In some embodiments, at least one Ang2 binding MRD is operably linked to the C-terminus of the heavy chain of an antibody that binds to VEGF. In some embodiments, at least one Ang2 binding MRD is operably linked to the N-terminus of the heavy chain of an antibody that binds to VEGF. In some embodiments, at least one Ang2 binding MRD is operably linked to the C-terminus of the light chain of an antibody that binds to VEGF. In some embodiments, at least one Ang2 binding MRD is operably linked to the N-terminus of the light chain of an antibody that binds to VEGF.

In some embodiments, at least one Ang2 binding MRD is operably linked directly to an antibody that binds to VEGF. In additional embodiments, at least one Ang2 binding MRD is operably linked to an antibody that binds to VEGF via a linker.

In some embodiments, an antibody that binds to VEGF is operably linked to an MRD that targets IGF1R. In some embodiments, the antibody that binds to VEGF is linked to an IGF binding MRD that binds to the same IGF epitope as an MRD comprising the sequence of SEQ ID NO:14. In some embodiments, the antibody that binds to VEGF is linked to an IGF1R binding MRD that competitively inhibits an MRD comprising the sequence of SEQ ID NO:14. In some embodiments, the antibody that binds to VEGF is linked to an MRD comprising the sequence of SEQ ID NO:14. In some embodiments, the antibody that binds ErbB2 is linked to an MRD encoding the sequence SLFVPRPERK (SEQ ID NO:103). In some embodiments, the antibody that binds ErbB2 is linked to an MRD encoding the sequence ESDVLHFTST (SEQ ID NO:104). In some embodiments, the antibody that binds ErbB2 is linked to an MRD encoding the sequence LRKYADGTL (SEQ ID NO:105).

In some embodiments, at least one IGF1R binding MRD is operably linked to the C-terminus of the heavy chain of an antibody that binds to VEGF. In some embodiments, at least one IGF1R binding MRD is operably linked to the N-terminus of the heavy chain of an antibody that binds to VEGF. In some embodiments, at least one IGF1R binding MRD is operably linked to the C-terminus of the light chain of an antibody that binds to VEGF. In some embodiments, at least one IGF1R binding MRD is operably linked to the N-terminus of the light chain of an antibody that binds to VEGF.

In some embodiments, at least one IGF1R binding MRD is operably linked directly to an antibody that binds to VEGF. In additional embodiments, at least one IGF1R binding MRD is operably linked to an antibody that binds to VEGF via a linker.

In some embodiments, the MRD-containing antibody targets VEGF, Ang2, and IGF1R. In some embodiments, the MRD-containing antibody comprises an antibody that targets VEGF, an MRD that targets Ang2, and an MRD that targets IGF1R. In some embodiments, the Ang2 and IGF1R MRDs are attached to the same location on the anti-VEGF antibody. In some embodiments, the Ang2 and IGF1R MRDs are attached to different locations on the anti-VEGF antibody. In some embodiments, the Ang2 and IGF1R MRDs are on the light chain of the anti-VEGF antibody. In some embodiments, the Ang2 and IGF1R MRDs are on the heavy chain of the anti-VEGF antibody. In some embodiments, the Ang2 MRD is on the light chain of the anti-VEGF antibody, and the IGF1R MRD is on the heavy chain of the anti-VEGF antibody. In some embodiments, the Ang2 MRD is on the heavy chain of the anti-VEGF antibody, and the IGF1R MRD is on the light chain of the anti-VEGF antibody. In some embodiments, the Ang2 MRD is on the N-terminus of the heavy chain of the anti-VEGF antibody, and the IGF1R MRD is on the C-terminus of the light chain of the anti-VEGF antibody. In some embodiments, the IGF1R MRD is on the N-terminus of the heavy chain of the anti-VEGF antibody, and the Ang2 MRD is on the C-terminus of the light chain of the anti-VEGF antibody.

In some embodiments, the anti-VEGF antibody operably linked to an Ang2 binding MRD binds to both anti-VEGF and Ang2 simultaneously. In some embodiments, the anti-VEGF antibody operably linked to an IGF1R binding MRD binds to both anti-VEGF and IGFR1 simultaneously. In some embodiments, the anti-VEGF antibody operably linked to an Ang2 binding MRD and an IGF1R binding MRD binds to VEGF, Ang2, and IGF1R simultaneously. In some embodiments, the anti-VEGF antibody operably linked to an Ang2 and/or IGF1R binding MRD(s) exhibits ADCC activity. In additional embodiments, the anti-VEGF antibody operably linked to an Ang2 and/or IGF1R binding MRD(s) down-regulates VEGF signaling. In additional embodiments, the anti-VEGF antibody operably linked to an Ang2 binding MRD inhibits Ang2 binding to TIE2. In additional embodiments, the anti-VEGF antibody operably linked to an IGF1R binding MRD inhibits IGF1R signaling. In additional embodiments, the anti-VEGF antibody operably linked to an Ang2 and/or IGF1R binding MRD(s) inhibits cell proliferation. In additional embodiments, the anti-VEGF antibody operably linked to an Ang2 and/or IGF binding MRD(s) inhibits tumor growth.

In some embodiments, the anti-ErbB2 antibody or the VEGF antibody contains and MRD that inhibits the binding of pertuzumab to ErbB2. In some embodiments, an anti-ErbB2 antibody contains at least one MRD that binds to Ang2 or IGF1R and one MRD that inhibits the binding of pertuzumab to ErbB2. In some embodiments, an anti-VEGF antibody contains at least one MRD that binds to Ang2 or IGF1R and one MRD that inhibits the binding of pertuzumab to ErbB2. In some embodiments, an anti-ErbB2 antibody contains an MRD that binds Ang2, an MRD that binds IGF1R, and an MRD that inhibits the binding of pertuzumab to ErbB2. In some embodiments, an anti-VEGF antibody contains an MRD that binds Ang2, an MRD that binds IGF1R, and an MRD that inhibits the binding of pertuzumab to ErbB2.

In specific embodiments, the MRD-containing antibody targets TNF and an angiogenic factor. In another embodiment, the antibody targets TNF, and at least one MRD targets an angiogenic factor. In one embodiment, an antibody that binds to the same TNF epitope as adalimumab is operably linked to at least one MRD that targets an angiogenic factor. In an additional embodiment, an antibody that competitively inhibits adalimumab binding is operably linked to at least one MRD that targets an angiogenic factor. In additional embodiments, an antibody that comprises the sequences of SEQ ID NOs:80-85 is operably linked to at least one MRD that targets an angiogenic factor. In additional embodiments, the adalimumab antibody is operably linked to at least one MRD that targets an angiogenic factor. In one embodiment, an antibody that binds to the same TNF epitope as golimumab is operably linked to at least one MRD that targets an angiogenic factor. In an additional embodiment, an antibody that competitively inhibits golimumab binding is operably linked to at least one MRD that targets an angiogenic factor. In additional embodiments, the golimumab antibody is operably linked to at least one MRD that targets an angiogenic factor.

In some embodiments, an antibody that binds to TNF is operably linked to an MRD that targets Ang2. In some embodiments, the antibody that binds to TNF is linked to an Ang2 binding MRD that binds to the same Ang2 epitope as an MRD comprising the sequence of SEQ ID NO:8. In some embodiments, the antibody that binds to TNF is linked to an Ang2 binding MRD that competitively inhibits an MRD comprising the sequence of SEQ ID NO:8. In some embodiments, the antibody that binds to TNF is linked to an MRD comprising the sequence of SEQ ID NO:8.

In some embodiments, at least one Ang2 binding MRD is operably linked to the C-terminus of the heavy chain of an antibody that binds to TNF. In some embodiments, at least one Ang2 binding MRD is operably linked to the N-terminus of the heavy chain of an antibody that binds to TNF. In some embodiments, at least one Ang2 binding MRD is operably linked to the C-terminus of the light chain of an antibody that binds to TNF. In some embodiments, at least one Ang2 binding MRD is operably linked to the N-terminus of the light chain of an antibody that binds to TNF.

In some embodiments, at least one Ang2 binding MRD is operably linked directly to an antibody that binds to TNF. In additional embodiments, at least one Ang2 binding MRD is operably linked to an antibody that binds to TNF via a linker.

In some embodiments, the anti-TNF antibody operably linked to an Ang2 binding MRD binds to both TNF and Ang2 simultaneously. In some embodiments, the anti-TNF antibody operably linked to an Ang2 binding MRD exhibits ADCC activity. In additional embodiments, the anti-TNF antibody operably linked to an Ang2 binding MRD inhibits binding of TNF to the p55 and p75 cell surface TNF receptors. In additional embodiments, the anti-TNF antibody operably linked to an Ang2 binding MRD lyses surface TNF-expressing cells in vitro in the presence of complement. In additional embodiments, the anti-TNF antibody operably linked to an Ang2 binding MRD inhibits Ang2 binding to TIE2. In additional embodiments, the anti-TNF antibody operably linked to an Ang2 binding MRD reduces the signs and symptoms of arthritis.

In some embodiments, the MRD-containing antibody targets TNF and IL6. In some embodiments, the MRD-containing antibody is capable of binding TNF and IL6 simultaneously. Thus, in some embodiments, an antibody that binds to TNF is operably linked to an MRD that targets IL6. In other embodiments, an antibody that binds to IL6 is operably linked to an MRD that targets TNF.

In some embodiments, at least one IL6-binding MRD is operably linked to the C-terminus of the heavy chain of an antibody that binds TNF. In some embodiments, at least one IL6-binding MRD is operably linked to the N-terminus of the heavy chain of an antibody that binds to TNF. In some embodiments, at least one IL6-binding MRD is operably linked to the C-terminus of the light chain of an antibody that binds to TNF. In some embodiments, at least one IL6-binding MRD is operably linked to the N-terminus of the light chain of an antibody that binds to TNF.

In some embodiments, at least one TNF-binding MRD is operably linked to the C-terminus of the heavy chain of an antibody that binds IL6. In some embodiments, at least one TNF-binding MRD is operably linked to the N-terminus of the heavy chain of an antibody that binds to IL6. In some embodiments, at least one TNF-binding MRD is operably linked to the C-terminus of the light chain of an antibody that binds to IL6. In some embodiments, at least one TNF-binding MRD is operably linked to the N-terminus of the light chain of an antibody that binds to IL6.

In some embodiments, at least one IL6-binding MRD is operably linked directly to an antibody that binds to TNF. In additional embodiments, at least one IL6-binding MRD is operably linked to an antibody that binds to TNF via a linker.

In some embodiments, at least one TNF-binding MRD is operably linked directly to an antibody that binds to IL6. In additional embodiments, at least one TNF-binding MRD is operably linked to an antibody that binds to IL6 via a linker.

In some embodiments, the MRD-containing antibody targets TNF and BLyS. In some embodiments, the MRD-containing antibody is capable of binding TNF and BLyS simultaneously. In some embodiments, an antibody that binds to TNF is operably linked to an MRD that targets BLyS. In other embodiments, an antibody that binds to BLyS is operably linked to an MRD that targets TNF.

In some embodiments, at least one BLyS-binding MRD is operably linked to the C-terminus of the heavy chain of an antibody that binds TNF. In some embodiments, at least one BLyS-binding MRD is operably linked to the N-terminus of the heavy chain of an antibody that binds to TNF. In some embodiments, at least one BLyS-binding MRD is operably linked to the C-terminus of the light chain of an antibody that binds to TNF. In some embodiments, at least one BLyS-binding MRD is operably linked to the N-terminus of the light chain of an antibody that binds to TNF.

In some embodiments, at least one TNF-binding MRD is operably linked to the C-terminus of the heavy chain of an antibody that binds BLyS. In some embodiments, at least one TNF-binding MRD is operably linked to the N-terminus of the heavy chain of an antibody that binds to BLyS. In some embodiments, at least one TNF-binding MRD is operably linked to the C-terminus of the light chain of an antibody that binds to BLyS. In some embodiments, at least one TNF-binding MRD is operably linked to the N-terminus of the light chain of an antibody that binds to BLyS.

In some embodiments, at least one BLyS-binding MRD is operably linked directly to an antibody that binds to TNF. In additional embodiments, at least one BLyS-binding MRD is operably linked to an antibody that binds to TNF via a linker.

In other embodiments, at least one TNF-binding MRD is operably linked directly to an antibody that binds to BLyS. In additional embodiments, at least one TNF-binding MRD is operably linked to an antibody that binds to BLyS via a linker.

In some embodiments, the MRD-containing antibody targets Ang2, TNF, and IL6. In some embodiments, the MRD-containing antibody is capable of binding Ang2, TNF, and IL6 simultaneously. In some embodiments, an antibody that binds to TNF is operably linked to an MRD that targets Ang2 and an MRD that targets IL6. In some embodiments, the Ang2 and IL6-binding MRDs are located on the same antibody chain. In some embodiments, the Ang2 and IL6-binding MRDs are located on the same antibody terminus. In some embodiments, the Ang2 and IL6-binding MRDs are located on different antibody chains. In some embodiments, the Ang2 and IL6-binding MRDs are located on different antibody termini.

In some embodiments, an antibody that binds to Ang2 is operably linked to an MRD that targets TNF and an MRD that targets IL6. In some embodiments, the TNF and IL6-binding MRDs are located on the same antibody chain. In some embodiments, the TNF and IL6-binding MRDs are located on the same antibody terminus. In some embodiments, the TNF and IL6-binding MRDs are located on different antibody chains. In some embodiments, the TNF and IL6-binding MRDs are located on different antibody termini.

In some embodiments, an antibody that binds to IL6 is operably linked to an MRD that targets Ang2 and an MRD that targets TNF. In some embodiments, the Ang2 and TNF-binding MRDs are located on the same antibody chain. In some embodiments, the Ang2 and TNF-binding MRDs are located on the same antibody terminus. In some embodiments, the Ang2 and TNF-binding MRDs are located on different antibody chains. In some embodiments, the Ang2 and TNF-binding MRDs are located on different antibody termini.

In some embodiments, the MRD-containing antibody targets Ang2, TNF, and BLyS. In some embodiments, the MRD-containing antibody is capable of binding Ang2, TNF, and BLyS simultaneously. In some embodiments, an antibody that binds to TNF is operably linked to an MRD that targets Ang2 and an MRD that targets BLyS. In other embodiments, an antibody that binds to BLyS is operably linked to an MRD that targets TNF and an MRD that targets Ang2. In other embodiments, an antibody that binds to Ang2 is operably linked to an MRD that targets TNF and an MRD that targets BLyS. In some embodiments, the Ang2, BLyS, and/or TNF-binding MRDs are located on the same antibody chain. In some embodiments, Ang2, BLyS, and/or TNF-binding MRDs are located on the same antibody terminus. In some embodiments, the Ang2, BLyS, and/or TNF-binding MRDs are located on different antibody chains. In some embodiments, the Ang2, BLyS, and/or TNF-binding MRDs are located on different antibody termini.

In some embodiments, the MRD-containing antibody targets Ang2, TNF, IL6, and BLyS. In some embodiments, the MRD-containing antibody is capable of binding Ang2, TNF, IL6 and BLyS simultaneously. In some embodiments, an antibody that binds to TNF is operably linked to an MRD that targets Ang2, an MRD that targets IL6, and an MRD that targets BLyS. In some embodiments, an antibody that binds to Ang2 is operably linked to an MRD that targets TNF, an MRD that targets IL6, and an MRD that targets BLyS. In some embodiments, an antibody that binds to IL6 is operably linked to an MRD that targets Ang2, an MRD that targets TNF, and an MRD that targets BLyS. In some embodiments, an antibody that binds to BLyS is operably linked to an MRD that targets Ang2, an MRD that targets IL6, and an MRD that targets TNF. In some embodiments, the TNF, Ang2, IL6, and/or BLyS-binding MRDs are located on the same antibody chain. In some embodiments, the TNF, Ang2, IL6 and/or BLyS-binding MRDs are located on the same antibody terminus. In some embodiments, the TNF, Ang2, IL6, and/or BLyS-binding MRDs are located on different antibody chains. In some embodiments, the TNF, Ang2, IL6 and/or BLyS-binding MRDs are located on different antibody termini.

VI. Methods of Making Antibody-MRD Fusions

The multivalent and multispecific compositions of the invention (e.g., MRD-containing antibodies) and MRDs can be produced by any method known in the art for the synthesis of antibodies, polypeptides, immunoconjugates, and cytotoxins, in particular, by chemical synthesis or by recombinant expression techniques. An advantage of multivalent and multispecific compositions (e.g., MRD-containing antibodies) is that they can be produced using protocols that are known in the art for producing antibodies. The antibody-MRD fusion molecules can be encoded by a polynucleotide comprising a nucleotide sequence. Thus, the polynucleotides described herein can encode an MRD, an antibody heavy chain, an antibody light chain, a fusion protein comprising an antibody heavy chain and at least one MRD, and/or a fusion protein comprising an antibody light chain and at least one MRD.

Accordingly, the invention provides vector constructs comprising a polynucleotide sequence(s) encoding multivalent and multispecific compositions (e.g., MRD-containing antibodies) and a host cell comprising these vector constructs. Standard techniques for cloning and transformation may be used in the preparation of cell lines expressing the multivalent and multispecific compositions (e.g., MRD-containing antibodies) of the invention.

Recombinant expression vectors containing a polynucleotide sequence(s) encoding multivalent and multispecific compositions (e.g., MRD-containing antibodies) of the invention can be prepared using well known techniques. The expression vectors include a polynucleotide coding sequence operably linked to suitable transcriptional or translational regulatory nucleotide sequences such as, those derived from mammalian, microbial, viral, or insect genes. Exemplary regulatory sequences present in the expression vector constructs include transcriptional promoters, operators, enhancers, mRNA ribosomal binding sites, and/or other appropriate sequences which control transcription and translation initiation and termination. Nucleotide sequences are "operably linked" when the regulatory sequence functionally relates to the nucleotide sequence for the appropriate polypeptide. Thus, a promoter sequence is operably linked to, for example, an antibody heavy chain-MRD sequence if the promoter nucleotide sequence controls the transcription of the appropriate nucleotide sequence.

The polynucleotide coding sequence in the expression vector can include additional heterologous sequences encoding polypeptides such as, signal peptides that are not naturally associated with antibody heavy and/or light chain sequences. For example, a nucleotide sequence for a signal peptide (secretory leader) can be fused in-frame to the polypeptide sequence so that the MRD-containing antibody is secreted to the periplasmic space or into the medium. A signal peptide that is functional in the intended host cells enhances extracellular secretion of the appropriate antibody. The signal peptide can be cleaved from the polypeptide upon secretion of antibody from the cell. Examples of sequences encoding secretory signals that can be included in the expression vectors include those described in for example, U.S. Pat. Nos. 5,698,435, 5,698,417, and 6,204,023.

A variety of host-expression vector systems can be utilized to express the coding sequence an MRD-containing antibody.

Host cells useful in the present invention include but are not limited to microorganisms such as, bacteria (e.g., *E. coli, B. subtilis*) transformed with recombinant bacteriophage DNA, plasmid DNA or cosmid DNA expression vectors containing antibody coding sequences; yeast (e.g., *Saccharomyces, Pichia*) transformed with recombinant yeast expression vectors containing antibody coding sequences; insect cell systems infected with recombinant virus expression vectors (e.g., Baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing MRD-containing antibody coding sequences. In particular embodiments, the mammalian cell systems are used to produce the multivalent and multispecific compositions of the invention (e.g., MRD-containing antibodies). Mammalian cell systems typically utilize recombinant expression constructs containing promoters derived from the genome of mammalian cells (e.g., metallothionein promoter) or from mammalian viruses (e.g., the adenovirus late promoter; the vaccinia virus 7.5K promoter). Examples of mammalian host cells useful for producing the multivalent and multispecific compositions of the invention include, CHO cells, BHK cells, NS0 cells, SP2/0 cells, YO myeloma cells, P3X63 mouse myeloma cells, PER cells, PER.C6 cells, COS cells, 293 cells, 3T3 cells and hybridoma cells.

Vectors containing the polynucleotides encoding the multivalent and multispecific compositions of the invention (e.g., MRD containing antibodies) or portions or fragments thereof, include plasmid vectors, a single and double-stranded phage vectors, as well as single and double-stranded RNA or DNA viral vectors. The vectors can be routinely introduced into host cells using known techniques for introducing DNA and RNA into cells. Phage and viral vectors may also be introduced into host cells in the form of packaged or encapsulated virus using known techniques for infection and transduction. Moreover, viral vectors may be replication competent or alternatively, replication defective. Alternatively, cell-free translation systems may also be used to produce the protein using RNAs derived from the DNA expression constructs of the invention (see, e.g., Intl. Appl. Publ. WO86/05807 and WO89/01036; and U.S. Pat. No. 5,122,464).

Also provided herein, are methods of producing an MRD-containing antibody, the method comprising: culturing a host cell comprising one or more polynucleotides or an expression vector comprising one or more isolated polynucleotides in a medium under conditions allowing the expression of said one or more polynucleotide, wherein said one or more polynucleotides encodes one or more polypeptides that form part of MRD-containing antibody; and recovering said MRD-containing antibody.

Prokaryotes useful as host cells in producing the compositions of the invention (e.g., MRDs) include gram negative or gram positive organisms such as, *E. coli* and *B. subtilis*. Expression vectors for use in prokaryotic host cells generally contain one or more phenotypic selectable marker genes (e.g., genes encoding proteins that confer antibiotic resistance or that supply an autotrophic requirement). Examples of useful prokaryotic host expression vectors include the pKK223-3 (Pharmacia, Uppsala, Sweden), pGEM1 (Promega, Wis., USA), pET (Novagen, Wis., USA) and pRSET (Invitrogen, Calif., USA) series of vectors (see, e.g., Studier, J. Mol. Biol. 219:37 (1991) and Schoepfer, Gene 124:83 (1993)). Exemplary promoter sequences frequently used in prokaryotic host cell expression vectors include T7, (Rosenberg et al., Gene 56: 125-135 (1987)), beta-lactamase (penicillinase), lactose promoter system (Chang et al., Nature 275:615 (1978)); and Goeddel et al., Nature 281:544 (1979)), tryptophan (trp) promoter system (Goeddel et al., Nucl. Acids Res. 8:4057, (1980)), and tac promoter (Sambrook et al., 1990, Molecular Cloning, A Laboratory Manual, 2d Ed., Cold Spring Harbor Laboratory, Cold Spring Harbor, N.Y.).

In alternative embodiments, eukaryotic host cell systems can be used, including yeast cells transformed with recombinant yeast expression vectors containing the coding sequence of an MRD-containing antibody of the present invention, such as, the expression systems taught in U.S. Pat. Appl. No. 60/344,169 and WO03/056914 (methods for producing human-like glycoprotein in a non-human eukaryotic host cell) (the contents of each of which are incorporated by reference in their entirety). Exemplary yeast that can be used to produce compositions of the invention, such as, MRDs, include yeast from the genus *Saccharomyces, Pichia, Actinomycetes* and *Kluyveromyces*. Yeast vectors typically contain an origin of replication sequence from a 2mu yeast plasmid, an autonomously replicating sequence (ARS), a promoter region, sequences for polyadenylation, sequences for transcription termination, and a selectable marker gene. Examples of promoter sequences in yeast expression constructs include, promoters from metallothionein, 3-phosphoglycerate kinase (Hitzeman et al., J. Biol. Chem. 255:2073, (1980)) and other glycolytic enzymes, such as, enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase. Additional suitable vectors and promoters for use in yeast expression as well as yeast transformation protocols are known in the art. See, e.g., Fleer et al., Gene, 107:285-195 (1991) and Hinnen et al., Proc. Natl. Acad. Sci., 75:1929 (1978).

Insect and plant host cell culture systems are also useful for producing the compositions of the invention. Such host cell systems include for example, insect cell systems infected with recombinant virus expression vectors (e.g., baculovirus) containing the coding sequence of an MRD-containing antibody; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing the coding sequence of an MRD-containing antibody, including, but not limited to, the expression systems taught in U.S. Pat. No. 6,815,184, WO2004/057002, WO2004/024927, U.S. Pat. Appl. Nos. 60/365,769, 60/368, 047, and WO2003/078614, the contents of each of which is herein incorporated by reference in its entirety.

In alternate embodiments, other eukaryotic host cell systems may be used, including animal cell systems infected with recombinant virus expression vectors (e.g., adenovirus, vaccinia virus) including cell lines engineered to contain multiple copies of the DNA encoding an MRD-containing antibody either stably amplified (CHO/dhfr) or unstably amplified in double-minute chromosomes (e.g., murine cell lines). In one embodiment, the vector comprising the polynucleotide(s) encoding the MRD-containing antibody of the invention is polycistronic.

Exemplary mammalian cells useful for producing these compositions include 293 cells (e.g., 293T and 293F), CHO cells, BHK cells, NS0 cells, SP2/0 cells, YO myeloma cells, P3X63 mouse myeloma cells, PER cells, PER.C6 (Crucell, Netherlands) cells or hybridoma cells, other mammalian cells. Additional exemplary mammalian host cells that are useful in practicing the invention include but are not limited, to VERY, Hela, COS, MDCK, 3T3, W138, BT483, Hs578T, HTB2, BT20 and T47D, CRL7O3O and HsS78Bst cells. Some examples of expression systems and selection methods are described in the following references and references cited therein: Borth et al., Biotechnol. Bioen. 71(4):266-73 (2000-2001), in Werner et al., Arzneimittelforschung/Drug Res. 48(8):870-80 (1998), in Andersen and Krummen, Curr. Op. Biotechnol. 13:117-123 (2002), in Chadd and Chamow, Curr. Op. Biotechnol. 12:188-194 (2001), and in Giddings, Curr. Op. Biotechnol. 12: 450-454 (2001). Additional examples of expression systems and selection methods are described in Logan & Shenk, Proc. Natl. Acad. Sci. USA, 81:355-359 (1984), Bittner et al., Methods in Enzymol. 153:51-544 (1987)). Transcriptional and translational control sequences for mammalian host cell expression vectors are frequently derived from viral genomes. Commonly used promoter sequences and enhancer sequences in mammalian expression vectors include, sequences derived from Polyoma virus, Adenovirus 2, Simian Virus 40 (SV40), and human cytomegalovirus (CMV). Exemplary commercially available expression vectors for use in mammalian host cells include pCEP4 (Invitrogen®) and pcDNA3 (Invitrogen®).

A number of selection systems can be used in mammalian host-vector expression systems, including, but not limited to, the herpes simplex virus thymidine kinase, hypoxanthine-guanine phosphoribosyltransferase and adenine phosphoribosyltransferase (Lowy et al., Cell 22:817 (1980)) genes, which can be employed in tk, hgprt⁻ or aprt⁻ cells, respectively. Additionally, antimetabolite resistance can be used as the basis of selection for e.g., dhfr, gpt, neo, hygro, trpB, hisD, ODC (ornithine decarboxylase), and the glutamine synthase system.

Methods which are well known to those skilled in the art can be used to construct expression vectors containing the coding sequence of an MRD-containing antibody along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989) and Ausubel et al., CURRENT PROTOCOLS IN MOLECULAR BIOLOGY, Greene Publishing Associates and Wiley Interscience, N.Y (1989).

A variety of host-expression vector systems may be utilized to express the coding sequence an MRD-containing antibody. A host cell strain can be chosen which modulates the expression of inserted antibody sequences, or modifies and processes the antibody gene product in the specific fashion desired. Such modifications (e.g., glycosylation) and processing (e.g., cleavage) of protein products can be important for the function of the protein. Different host cells have characteristic and specific mechanisms for the post-translational processing and modification of proteins and gene products. Appropriate cell lines or host systems can be chosen to ensure the correct modification and processing of the antibody or portion thereof expressed. To this end, eukaryotic host cells which possess the cellular machinery for proper processing of the primary transcript, glycosylation, and phosphorylation of the gene product may be used.

Stable expression typically achieves more reproducible results than transient expression and also is more amenable to large-scale production; however, it is within the skill of one in the art to determine whether transient expression is better for a particular situation. Rather than using expression vectors which contain viral origins of replication, host cells can be transformed with the respective coding nucleic acids controlled by appropriate expression control elements (e.g., promoter, enhancer, sequences, transcription terminators, polyadenylation sites, etc.), and a selectable marker. Following the introduction of foreign DNA, engineered cells may be allowed to grow for 1-2 days in an enriched media, and then are switched to a selective media. The selectable marker in the recombinant plasmid confers resistance to the selection and allows selection of cells which have stably integrated the plasmid into their chromosomes and grow to form foci which in turn can be cloned and expanded into cell lines.

In some embodiments, the multivalent and multispecific compositions (e.g., MRD-containing antibodies) are expressed at levels (titers) comparable to those of antibodies. In some embodiments, the multivalent and multispecific compositions (e.g., MRD-containing antibodies) are expressed at least about 10 µg/ml, at least about 20 µg/ml, or at least about 30 µg/ml. In some embodiments, the multivalent and multispecific compositions (e.g., MRD-containing antibodies) are expressed at least about 40 µg/ml or at least about 50 µg/ml. In some embodiments, the multivalent and multispecific compositions (e.g., MRD-containing antibodies) are expressed at least about 60 µg/ml, at least about 70 µg/ml, at least about 80 µg/ml, at least about 90 µg/ml, at least about 95 µg/ml, at least about 100 µg/ml, at least about 110 µg/ml, at least about 120 µg/ml, at least about 130 µg/ml, at least about 140 µg/ml, at least about 150 µg/ml, at least about 160 µg/ml, at least about 170 µg/ml, at least about 180 µg/ml, at least about 190 µg/ml, or at least about 200 µg/ml. The expression levels of an antibody molecule can be increased by vector amplification and the use recombinant methods and tools known in the art, including chromatin remodeling strategies to enhance transgene expression.

The present invention is further directed to a method for modifying the glycosylation profile of an MRD-containing antibody that is produced by a host cell, comprising expressing in said host cell a nucleic acid encoding an MRD-containing antibody and a nucleic acid encoding a polypeptide with a glycosyltransferase activity, or a vector comprising such nucleic acids. Genes with glycosyltransferase activity include β(1,4)-N-acetylglucosaminyltransferase III (GnTII), α-mannosidase II (ManII), β(1,4)-galactosyltransferase (GalT), β(1,2)-N-acetylglucosaminyltransferase I (GnTI), and β(1,2)-N-acetylglucosaminyltransferase II (GnTII). In one embodiment, a combination of genes with glycosyltransferase activity are expressed in the host cell (e.g., GnTIII and Man II). Likewise, the method also encompasses expression of one or more polynucleotide(s) encoding the MRD-containing antibody in a host cell in which a glycosyltransferase gene has been disrupted or otherwise deactivated (e.g., a host cell in which the activity of the gene encoding α1-6 core fucosyltransferase has been knocked out). In another embodiment, the MRD-containing antibody can be produced in a host cell that further expresses a polynucleotide encoding a polypeptide having GnTIII activity to modify the glycosylation pattern. In a specific embodiment, the polypeptide having GnTIII activity is a fusion polypeptide comprising the Golgi localization domain of a Golgi resident polypeptide. In another embodiment, the expression of the MRD-containing antibody in a host cell that expresses a polynucleotide encoding a polypeptide having GnTIII activity results in an MRD-containing antibody with increased Fc receptor binding affinity and increased effector function. Accordingly, in one embodiment, the present invention is directed to a host cell comprising (a) an isolated nucleic acid comprising a sequence encoding a polypeptide having GnTIII activity; and (b) an isolated polynucleotide encoding an MRD-containing antibody of the present invention, such as, a chimeric, primatized or humanized antibody. In another embodiment, the polypeptide having GnTIII activity is a fusion polypeptide comprising the catalytic domain of GnTIII and the Golgi localization domain is the localization domain of mannosidase II. Methods for generating such fusion polypeptides and using them to produce antibodies with increased effector functions are disclosed in U.S. Provisional Pat. Appl. No. 60/495,142 and U.S. Pat. Appl. Publ. No. 2004/0241817, each of which is herein incorporated by reference.

The multivalent and multispecific compositions (e.g., MRD-containing antibodies) with altered glycosylation produced by the host cells of the invention typically exhibit increased Fc receptor binding affinity and/or increased effector function as a result of the modification of the host cell (e.g., by expression of a glycosyltransferase gene). The increased Fc receptor binding affinity can be increased binding to an Fcγ activating receptor, such as, the FcγRIIIa receptor. The increased effector function can be an increase in one or more of the following: increased antibody-dependent cellular cytotoxicity, increased antibody-dependent cellular phagocytosis (ADCP), increased cytokine secretion, increased immune-complex-mediated antigen uptake by antigen-presenting cells, increased Fc-mediated cellular cytotoxicity, increased binding to NK cells, increased binding to macrophages, increased binding to polymorphonuclear cells (PMNs), increased binding to monocytes, increased crosslinking of target-bound antibodies, increased direct signaling inducing apoptosis, increased dendritic cell maturation, and increased T cell priming.

Once a multivalent and monovalent multispecific composition (e.g., MRD-containing antibody) of the invention has been produced by recombinant expression, it can be purified by any method known in the art for purification of an immunoglobulin molecule, for example, by chromatography (e.g., ion exchange, affinity, particularly by affinity for the specific antigen after Protein A, and sizing column chromatography), centrifugation, differential solubility, or by any other standard technique for the purification of proteins. In additional embodiments, the multivalent and multispecific compositions of the present invention or fragments thereof are optionally fused to heterologous polypeptide sequences described herein or otherwise known in the art to facilitate purification. In additional embodiments, the multivalent and multispecific compositions or fragments thereof are optionally fused to heterologous polypeptide sequences described herein or otherwise known in the art to facilitate purification. More particularly, it is envisioned that ligands (e.g., antibodies and other affinity matrices) for MRDs or other components of the multivalent and multispecific compositions can be used in affinity columns for affinity purification and that optionally, the MRDs or other components of the multivalent and monovalent multispecific composition that are bound by these ligands are removed from the composition prior to final preparation of the multivalent and multispecific compositions using techniques known in the art.

VII. Uses of Antibody-MRD Fusions

The multivalent and multispecific compositions (e.g., MRD-containing antibodies) described herein are useful in a variety of applications including, but not limited to, therapeutic treatment methods, such as, the treatment of cancer. In certain embodiments, the multivalent and multispecific compositions (e.g., MRD-containing antibodies) are useful for inhibiting tumor growth, reducing neovascularization, reducing angiogenesis, inducing differentiation, reducing tumor volume, and/or reducing the tumorigenicity of a tumor. The methods of use may be in vitro, ex vivo, or in vivo methods. Cancer therapies and their dosages, routes of administration and recommended usage are known in the art and have been described in such literature as the Physician's Desk Reference (PDR). The PDR discloses dosages of the agents that have been used in treatment of various cancers. The dosing regimen and dosages of these aforementioned chemotherapeutic drugs that are therapeutically effective will depend on the particular cancer being treated, the extent of the disease and other factors familiar to the physician of skill in the art and can be determined by the physician. The contents of the PDR are expressly incorporated herein in its entirety by reference. The 2006 edition of the Physician's Desk Reference (PDR) discloses the mechanism of action and preferred doses of treatment and dosing schedules for thalidomide (p 979-983), VELCADE® (p 2102-2106) and melphalan (p 976-979).

The multivalent and multispecific compositions (e.g., MRD-containing antibodies) are formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners. The dosage ranges for the administration of the multivalent and multispecific compositions of the invention are those large enough to produce the desired effect in which the disease symptoms mediated by the target molecule are ameliorated. The dosage should not be so large as to cause adverse side effects, such as, hyperviscosity syndromes, pulmonary edema, congestive heart failure, and the like. Generally, the dosage will vary with the age, condition, sex and extent of the disease in the patient and can be determined by one of skill in the art. The dosage can be adjusted by the individual physician in the event of any complication.

The preparation of a pharmacological composition that contains active ingredients dissolved or dispersed therein is well understood in the art. Typically such compositions are prepared as sterile injectables either as liquid solutions or suspensions, aqueous or nonaqueous. However, solid forms suitable for solution, or suspensions, in liquid prior to use can also be prepared. The preparation can also be emulsified. Thus, an antibody-MRD containing composition can take the form of solutions, suspensions, tablets, capsules, sustained release formulations or powders, or other compositional forms.

In some embodiments, the compositions of the invention (e.g., multivalent and multispecific compositions (e.g., MRD-containing antibodies)) are formulated to ensure or optimize distribution in vivo. For example, the blood-brain barrier (BBB) excludes many highly hydrophilic compounds and if so desired, the compositions are prepared so as to increase transfer across the BBB, by for example, formulation in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., Ranade Clin. Pharmacol. 29:685 (1989)).

The multivalent and multispecific binding properties of the compositions of the invention provide for the rational design of therapeutics preferentially directed to particular anatomical sites of interest in vivo. For example, in some embodiments, the MRD-containing antibody localizes to a site of inflammation or to a tumor site by binding of the antibody combining site to a molecule characterized by increased expression in the inflammation or tumor site, respectively. In particular embodiments, the binding affinity of the antibody combining site in an MRD-containing antibody for the target in vivo is at least 3×, at least 10×, at least 30× or at least 100× that of one or more MRD targets bound by the MRD-containing antibody (e.g., a surface antigen that is not otherwise considered a viable antibody target in view of for example, non-specific surface expression, or low target binding affinity associated with conventional antibody technologies).

Therapeutic formulations of the invention optionally contain pharmaceutically acceptable carriers, excipients or stabilizers (Remington's Pharmaceutical Sciences 18th edition, Mack Publishing Co., Easton, Pa. 18042 [1990]). Acceptable carriers, excipients, or stabilizers are nontoxic to recipients at the dosages and concentrations employed, and include buffers, antioxidants including ascorbic acid, methionine, Vitamin E, sodium metabisulfite, preservatives, isotonicifiers, stabilizers, metal complexes (e.g., Zn-protein complexes), and/or chelating agents such as EDTA. Physiologically tolerable carriers are well known in the art. Likewise, multivalent and multispecific compositions (e.g., MRD-containing antibodies) of the present invention can include pharmaceutically acceptable salts of the components therein. Pharmaceutically acceptable salts include the acid addition salts (formed with the free amino groups of the polypeptide) that are formed with inorganic acids for example, hydrochloric or phosphoric acids, or such organic acids as acetic, tartaric, mandelic and the like. Salts formed with the free carboxyl groups can also be derived from inorganic bases for example, sodium, potassium, ammonium, calcium or ferric hydroxides, and such organic bases as isopropylamine, trimethylamine, 2-ethylamino ethanol, histidine, procaine and the like.

Suitable excipients include, for example, water, saline, dextrose, glycerol, ethanol or the like and combinations thereof. Additional excipients useful in formulation the compositions of the invention include an agent which can act as: (1) a bulking agent, (2) a solubility enhancer, and (3) a stabilizer. Such excipients include, but are not limited to: polyhydric sugar alcohols (enumerated above); amino acids such as alanine, glycine, glutamine, asparagine, histidine, arginine, lysine, ornithine, leucine, 2-phenylalanine, glutamic acid, threonine, etc.; organic sugars or sugar alcohols such as sucrose, lactose, lactitol, trehalose, stachyose, mannose, sorbose, xylose, ribose, ribitol, myoinisitose, myo-inisitol, galactose, galactitol, glycerol, cyclitols (e.g., inositol), polyethylene glycol; sulfur containing reducing agents, such as urea, glutathione, thioctic acid, sodium thioglycolate, thioglycerol, .alpha.-monothioglycerol and sodium thio sulfate; low molecular weight proteins such as human serum albumin, bovine serum albumin, gelatin or other immunoglobulins; hydrophilic polymers such as polyvinylpyrrolidone; monosaccharides (e.g., xylose, mannose, fructose, glucose; disaccharides (e.g., lactose, maltose, sucrose); trisaccharides such as raffinose; and polysaccharides such as dextrin or dextran.

Buffers are used to control the pH in a range which optimizes the therapeutic effectiveness, especially if stability is pH dependent. In some embodiments buffers are present at a concentrations ranging from about 1 mM to about 200 mM, about 1 mM to about 100 mM or about 1 mM to about 50 mM. Suitable buffering agents for use in the formulations of the invention include both organic and inorganic acids and salts thereof. For example, citrate, phosphate, succinate, tartrate, fumarate, gluconate, oxalate, lactate, acetate. Additionally, buffers may comprise histidine and trimethylamine salts such, as Tris.

Stabilizers, referred to as tonicity modifiers, are present to adjust or maintain the tonicity of a liquid composition. When used with large, charged biomolecules such as proteins and antibodies, stabilizers interact with the charged groups of the amino acid side chains, to reduce the potential for inter and intra-molecular interactions. Examples of tonicity agents useful in preparing the formulations of the invention include polyhydric sugar alcohols, preferably trihydric or higher sugar alcohols, such as glycerin, erythritol, arabitol, xylitol, sorbitol and mannitol.

Liquid compositions can also contain liquid phases in addition to and to the exclusion of water. Exemplary of such additional liquid phases are glycerin, vegetable oils such as, cottonseed oil, organic esters such as, ethyl oleate, and water-oil emulsions.

In one embodiment, a therapeutic composition contains a multivalent and monovalent multispecific composition (e.g., MRD-containing antibody) in an amount of at least 0.1 weight percent of MRD-containing antibody fusion per weight of total therapeutic composition. A weight percent is a ratio by weight of MRD-containing antibody per total composition. Thus, for example, 0.1 weight percent is 0.1 grams of MRD-containing antibody per 100 grams of total composition.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. In the subject invention, pharmaceutically acceptable carriers include, but are not limited to, 0.01-0.1M and preferably 0.05M phosphate buffer or 0.8% saline. Other common parenteral vehicles include sodium phosphate solutions, Ringer's dextrose, dextrose and sodium chloride, lactated Ringer's, or fixed oils. Intravenous vehicles include fluid and nutrient replenishers, electrolyte replenishers, such as those based on Ringer's dextrose, and the like. Preservatives and other additives may also be present such as for example, antimicrobials, antioxidants, chelating agents, and inert gases and the like.

More particularly, pharmaceutical compositions suitable for injectable typically use include sterile aqueous solutions (where water soluble) or dispersions and sterile powders for the extemporaneous preparation of sterile injectable solutions or dispersions. In such cases, the composition must be sterile and should be fluid to the extent that easy syringability exists. It should be stable under the conditions of manufacture and storage and will preferably be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Suitable formulations for use in the therapeutic methods disclosed herein are described in Remington's Pharmaceutical Sciences, Mack Publishing Co., 16th ed. (1980).

Prevention of the action of microorganisms can be achieved by various antibacterial and antifungal agents, for example, parabens, chlorobutanol, phenol, ascorbic acid, thimerosal and the like. In many cases, it will be preferable to include isotonic agents, for example, sugars, polyalcohols, such as mannitol, sorbitol, or sodium chloride in the composition. Prolonged absorption of the injectable compositions can be brought about by including in the composition an agent which delays absorption, for example, aluminum monostearate and gelatin.

In one embodiment, the pharmaceutical composition formulations of the invention comprise a compound that is capable of reducing the viscosity of an aqueous formulation comprising multivalent and monovalent multispecific compositions. In one embodiment, the multivalent and monovalent multispecific composition is an MRD-containing antibody. In a further embodiment, the compound that is capable of reducing the viscosity of the formulation is selected from the group consisting of: methionine, arginine (e.g., arginine succinate), arginine dipeptide, arginine tripeptide, polyarginine, homoarginine, N-hydroxy-L-nor-arginine, nitroarginine methyl ester, argininamide, arginine methyl ester, arginine ethyl ester, lysine, lysinamide, lysine methyl ester, histidine, histidine methyl ester, histamine, alanine, alaninamide, alanine methyl ester, 2-amino-3-guanidino-propionic acid, guanidine, ornithine, agmatine, guanidobutyric acid, citrulline, putrescine, cadaverine, spermidine, spermine and urea. In some embodiments, the compound is present in the formulation at a concentration of at least 10 mM, at least 20 mM, at least 50 mM or at least 100 mM. In additional embodiments, the compound is present in the formulation at a concentration of between about 10 mM and 1 M. In further embodiments, the total protein concentration present in the formulation is at least 50 mg/ml, at least 75 mg/ml, at least 100 mg/ml, at least 150 mg/ml, at least 200 mg/ml or at least 250 mg/ml.

The dosage schedule and amounts effective for therapeutic and prophylactic uses, i.e., the "dosing regimen", will depend upon a variety of factors, including the cause, stage and severity of the disease or disorder, the health, physical status, age of the mammal being treated, and the site and mode of the delivery of the MRD-containing antibody. Therapeutic efficacy and toxicity of the complex and formation can be determined by standard pharmaceutical, pharmacological, and toxicological procedures in cell cultures or experimental animals. Data obtained from these procedures can likewise be used in formulating a range of dosages for human use. Moreover, therapeutic index (i.e., the dose therapeutically effective in 50 percent of the population divided by the dose lethal to 50 percent of the population ($ED_{50}/LD_{50}$)) can readily be determined using known procedures. The dosage is preferably within a range of concentrations that includes the $ED_{50}$ with little or no toxicity, and may vary within this range depending on the dosage form employed, sensitivity of the patient, and the route of administration.

The dosage regimen also takes into consideration pharmacokinetics parameters known in the art, such as, drug absorption rate, bioavailability, metabolism and clearance (see, e.g., Hidalgo-Aragones, J. Steroid Biochem. Mol. Biol. 58:611-617 (1996); Groning et al., Pharmazie 51:337-341 (1996); Fotherby Contraception 54:59-69 (1996); and Johnson et al., J. Pharm. Sci. 84:1144-1146 (1995)). It is well within the state of the art for the clinician to determine the dosage regimen for each subject being treated. Moreover, single or multiple administrations of a multivalent and monovalent multispecific composition (e.g., MRD-containing antibody) containing compositions can be administered depending on the dosage and frequency as required and tolerated by the subject. The duration of prophylactic and therapeutic treatment will vary depending on the particular disease or condition being treated. Some diseases are amenable to acute treatment whereas others require long-term, chronic therapy. When treating with an additional therapeutic agent, MRD-containing antibody) can be administered serially, or simultaneously with the additional therapeutic agent.

Therapeutically effective amounts of MRD-containing antibody of the invention vary according to, for example, the targets of the MRD-containing antibody and the potency of conjugated cytotoxic agents encompassed by various embodiments of the invention Thus, for example therapeutically effective dose of an a multivalent and monovalent multispecific composition (e.g., MRD-containing antibody) that "mops up" a soluble ligand, such as, TNF alpha, is expected to be higher than that for an a multivalent and monovalent multispecific composition (e.g., MRD-containing antibody) that redirects T cell effector function to a target on a hematological malignancy. Likewise, therapeutically effective amounts of a multivalent and multispecific compositions (e.g., MRD-containing antibodies) comprising a maytansinoid cytotoxic agent are likely to be lower than the dosage of an a multivalent and monovalent multispecific composition (e.g., MRD-containing antibody) comprising a less potent chemotherapeutic, such as, taxol, or the counterpart a multivalent and monovalent multispecific composition does not contain a cytotoxic agent.

According to one embodiment, a therapeutically effective dose of an a multivalent and monovalent multispecific composition (e.g., MRD-containing antibody) is an amount selected from about 0.00001 mg/kg to about 20 mg/kg, from about 0.00001 mg/kg to about 10 mg/kg, from about 0.00001 mg/kg to about 5 mg/kg, from about 0.0001 mg/kg to about 20 mg/kg, from about 0.0001 mg/kg to about 10 mg/kg, from about 0.0001 mg/kg to about 5 mg/kg, from about 0.001 mg/kg to about 20 mg/kg, from about 0.001 mg/kg to about 10 mg/kg, and from about 0.001 mg/kg to about 5 mg/kg of the patient's body weight, in one or more dose administrations daily, for one or several days.

According to another embodiment, a therapeutically effective amount of an a multivalent and monovalent multispecific composition (e.g., MRD-containing antibody) is an amount such that when administered in a physiologically tolerable composition is sufficient to achieve a plasma concentration of from about 0.1 microgram (μg) per milliliter (ml) to about 100 μg/ml, from about 1 μg/ml to about 5 μg/ml, and usually about 5 μg/ml. Stated differently, in another embodiment, the dosage can vary from about 0.1 mg/kg to about 300 mg/kg, from about 0.2 mg/kg to about 200 mg/kg, from about 0.5 mg/kg to about 20 mg/kg, in one or more dose administrations daily, for one or several days.

In some embodiments, the a multivalent and monovalent multispecific composition (e.g., MRD-containing antibody) is administered at about 1 mg/kg to about 50 mg/kg, about 1 mg/kg to about 25 mg/kg, about 1 mg/kg to about 20 mg/kg, about 1 mg/kg to about 15 mg/kg, about 1 mg/kg to about 10 mg/kg, or about 1 mg/kg to about 5 mg/kg.

In additional embodiments, the interval between dose administration of the multivalent and monovalent multispecific composition (e.g., an MRD-containing antibody) is about daily, about twice a week, about every week, about every other week, or about every three weeks. In some embodiments, the multivalent and monovalent multispecific composition is administered first at a higher loading dose and subsequently at a lower maintenance dose.

In further embodiments, therapeutic compositions of the invention comprise multivalent and multispecific compositions (e.g., MRD-containing antibodies) in an amount of at least 0.1 weight percent of antibody per weight of total therapeutic composition. A weight percent is a ratio by weight of antibody/total composition. Thus, for example, 0.1 weight percent is 0.1 grams of antibody-MRD per 100 grams of total composition. According to some embodiments, a therapeutic composition comprising a multivalent and monovalent multispecific composition contains about 10 micrograms (μg) per milliliter (ml) to about 100 milligrams (mg) per ml of antibody as active ingredient per volume of composition. In additional embodiments, a therapeutic composition comprising a multivalent and monovalent multispecific composition contains about 1 mg/ml to about 10 mg/ml (i.e., about 0.1 to 1 weight percent) of antibody as active ingredient per volume of composition.

As shown in the examples herein, a multivalent and multispecific composition (e.g., an MRD containing antibody) can have a similar PK profile to a corresponding antibody. Thus, in some embodiments, an antibody-MRD is administered in a dosing concentration and regimen that is the same as the antibody component of the antibody-MRD molecule alone (e.g., a commercial antibody, or a so-called "biosimilar" or a "biobetter" thereof). Likewise, the multivalent and multispecific composition can have a different PK profile from a corresponding antibody. For example, in in embodiments where the multivalent and multispecific compositions redirect a T cell response and/or include a cytotoxic agent, the dosing concentration is expected to be less than that of the corresponding antibody. In these instances, therapeutically effective dosing concentrations and regimens for these compositions can routinely be determined using factors and criteria known in the art.

The multivalent and multispecific compositions (e.g., MRD-containing antibodies) need not be, but optionally are, formulated with one or more agents currently used to prevent or treat the disorder in question. The effective amount of such other agents depends on the amount of multivalent and monovalent multispecific composition present in the formulation, the type of disorder or treatment, and other factors discussed above.

As discussed above, the appropriate dosage of the multivalent and monovalent multispecific composition (e.g., MRD-containing antibody) will depend on the type of disease to be treated, as defined above, the severity and course of the disease, previous therapy, the patient's clinical history, and the discretion of the attending physician. The multivalent and monovalent multispecific composition is suitably administered to the patient at one time or over a series of treatments. Preferably, the multivalent and monovalent multispecific composition is administered by intravenous infusion or by subcutaneous injections. According to some embodiments, the multivalent and monovalent multispecific composition is administered parenterally by injection or by gradual infusion over time. Although the target molecule can typically be accessed in the body by systemic administration and therefore most often treated by intravenous administration of therapeutic compositions, other tissues and delivery means are contemplated where there is likelihood that the tissue targeted contains the target molecule. Thus, the multivalent and monovalent multispecific composition can be administered intravenously, intraperitoneally, intramuscularly, subcutaneously, intracavity, transdermally, and can be delivered by peristaltic means. Multivalent and multispecific compositions can also be delivered by aerosol to airways and lungs. In some embodiments, the antibody-MRD molecule is administered by intravenous infusion. In some embodiments, the antibody-MRD molecule is administered by subcutaneous injection.

The therapeutic compositions containing a multivalent and monovalent multispecific composition (e.g., MRD-containing antibody) can conventionally be administered intravenously, as by injection of a unit dose, for example. The term "unit dose" when used in reference to a therapeutic composition of the present invention refers to physically discrete units suitable as unitary dosage for the patient, each unit containing a predetermined quantity of active material calculated to produce the desired therapeutic effect in association with the required diluent; i.e., carrier, or vehicle. In a specific embodiment, the therapeutic compositions containing a human monoclonal antibody or a polypeptide are administered subcutaneously.

The compositions of the invention are administered in a manner compatible with the dosage formulation, and in a therapeutically effective amount. The quantity to be administered depends on the patient to be treated, capacity of the patient's system to utilize the active ingredient, and degree of therapeutic effect desired. Precise amounts of active ingredient required to be administered depend on the judgment of the practitioner and are peculiar to each individual. However, suitable dosage ranges for systemic application are disclosed herein and depend on the route of administration. Suitable regimes for administration are also variable, but are typified by an initial administration followed by repeated doses at one or more hour intervals by a subsequent injection or other administration. Alternatively, continuous intravenous infusion sufficient to maintain concentrations in the blood in the ranges specified for in vivo therapies are contemplated.

In other embodiments, the invention provides a method for treating or preventing a disease, disorder, or injury comprising administering a therapeutically effective amount or prophylactically effective amount of antibody-MRD molecule to a patient in need thereof. In some embodiments, the disease, disorder or injury is cancer. In other embodiments, the disease, disorder or injury is a disease or disorder of the immune system, such as, inflammation or an autoimmune disease.

Multivalent and multispecific compositions (e.g., MRD-containing antibodies) are expected to have at least the same therapeutic efficacy as the antibody contained in the MRD antibody containing antibody when administered alone. Accordingly, it is envisioned that the multivalent and multispecific compositions (e.g., MRD-containing antibodies) can be administered to a patient to treat or prevent a disease, disorder, or injury for which the antibody contained in the MRD-containing antibody, or an antibody that functions in the same way as the antibody contained in the MRD-containing antibody, demonstrates a reasonably correlated beneficial activity in treating or preventing such disease, disorder or injury. This beneficial activity can be demonstrated in vitro, in an in vivo animal model, or in human clinical trials. In one embodiment, an MRD-containing antibody is administered to a patient to treat or prevent a disease, disorder or injury for which the antibody component of the MRD-containing antibody, or an antibody that functions in the same way as the antibody contained in the MRD-containing antibody, demonstrates therapeutic or prophylactic efficacy in vitro or in an animal model. In another embodiment, an MRD-containing antibody is administered to a patient to treat or prevent a disease, disorder or injury for which the antibody component of the MRD-containing antibody, or an antibody that functions in the same way as the antibody contained in the MRD-containing antibody, demonstrates therapeutic or prophylactic efficacy in humans. In another embodiment, an MRD-containing antibody is administered to a patient to treat or prevent a disease, disorder or injury for which the antibody component of the MRD-containing antibody, or an antibody that functions in the same way as the antibody contained in the MRD-containing antibody, has been approved by a regulatory authority for use in such treatment or prevention.

In another embodiment, an MRD-containing antibody is administered in combination with another therapeutic to treat or prevent a disease, disorder or injury for which the antibody component of the MRD-containing antibody, or an antibody that functions in the same way as the antibody contained in the MRD antibody, in combination with the therapeutic, or a different therapeutic that functions in the same way as the therapeutic in the combination, demonstrates therapeutic or prophylactic efficacy in vitro or in an animal model. In another embodiment, an MRD-containing antibody is administered in combination with another therapeutic to treat or prevent a disease, disorder or injury for which the antibody component of the MRD-containing antibody, or an antibody that functions in the same way as the antibody contained in the MRD antibody, in combination with the therapeutic, or a different therapeutic that functions in the same way as the therapeutic in the combination, demonstrates therapeutic or prophylactic efficacy in humans. In another embodiment, an MRD-containing antibody, is administered in combination with another therapeutic to treat or prevent a disease, disorder or injury for which the antibody component of the MRD-containing antibody, or an antibody that functions in the same way as the antibody contained in the MRD antibody, in combination with the therapeutic, or a different therapeutic that functions in the same way as the therapeutic in the combination, has been approved by a regulatory authority for use in such treatment or prevention. The administration of an MRD-containing antibody in combination with more than one therapeutic as described above is also encompassed by the invention.

According to one embodiment, an MRD-containing antibody is administered in combination with a compound that promotes apoptosis, inhibits apoptosis, promotes cell survival, inhibits cell survival, promotes senescence of diseased or aberrant cells, inhibits cell senescence, promotes cell proliferation, inhibits cell proliferation, promotes cell differentiation, inhibits cell differentiation, promotes cell activation, inhibits cell activation, promotes cell metabolism, inhibits cell metabolism, promotes cell adhesion, inhibits cell adhesion, promotes cell cycling or cell division, inhibits cell cycling or cell division, promotes DNA replication or repair, inhibits DNA replication or repair, promotes transcription or translation, or inhibits transcription or translation.

According to one embodiment, an MRD-containing antibody is administered in combination with a compound that promotes apoptosis or senescence of diseased or aberrant cells. In some embodiments, the MRD-containing antibody is administered in combination with a compound that agonizes, antagonizes or reduces the activity of: EGFR, ErbB2, cMET, TNFa, TGFb, integrin $\alpha v\beta 3$, TLR2, TLR3, TLR4, TLR5, TLR7, TLR8, TLR9, TNFR1, TNFRSF10A (TRAIL R1 DR4), TNFRSF10B (TRAIL R2 DR5), TNF, TRAIL, IFN beta, MYC, Ras, BCR, ABL, JNK, CKH2, CHK1, CDK1, RAC1, MEK, MOS, mTOR, AKT, NFkB, Ikk, IAP1, IAP2, XIAP, b-catenin, survivin, HDAC, HSP70, HSP90, proteasome 20S, topoisomerase 1, MDM2, E2F, or E2F1.

According to one embodiment, an MRD-containing antibody is administered in combination with a compound that inhibits cell survival. In some embodiments, the MRD-containing antibody is administered in combination with a compound that antagonizes or reduces the activity of: VEGF, VEGFR1, VEGFR2, IGF1R, IGF1, IGF2, PDGF-A, PDGF-B, PDGF-CC, PDGF-C, PDGF-D, PDGFRA, PDG- FRB, TFGa, TGFB3, PI3K, TNFSF13B (BLYS), TNFRSF13C (BAFFR), JNK, NFKB, SIP, integrin αvβ3, or survivin.

According to one embodiment, an MRD-containing antibody is administered in combination with a compound that regulates cell proliferation. In some embodiments, the MRD-containing antibody is administered in combination with a compound that antagonizes or reduces the activity of: VEGF, VEGFR, EGFR, ErbB2, NFKB, HIF, MUC1, MUC2, or HDAC.

According to one embodiment, an MRD-containing antibody is administered in combination with a compound that regulates cell adhesion. In some embodiments, the MRD-containing antibody is administered in combination with a compound that inhibits or reduces the activity of: MMP1, MMP2, MMP7, MMP9, MMP12, PLAU, αvβ1 integrin, αvβ3 integrin, αvβ5 integrin, TGFb, EPCAM, α1β1 integrin, α2β1 integrin, α4β1 integrin, α2β1 integrin, α5β1 integrin, α9β1 integrin, α6β4 integrin, αMβ2 integrin, CEA, L1, Mel-CAM, or HIF1. In one embodiment the MRD-containing antibody is administered in combination with a compound that inhibits or reduces the activity of αvβ3 integrin, αvβ5 integrin, or α5β1 integrin. In specific embodiments the MRD-containing antibody is administered in combination with: MEDI-522 (VITAXIN, Abegrin; MedImmune), ATN-161 (Attenuon), EMD 121974 (Merck KGaA), CNTO 95 (Cenotocor), or velociximab (M200, Protein Design Labs).

According to one embodiment, an MRD-containing antibody is administered in combination with a compound that regulates cell activation. In some embodiments, the MRD-containing antibody is administered in combination with a compound that promotes, inhibits or reduces the activity of: CD80, CD86, MHC, PDL2 (B7-DC), B7-H1, B7-H2 (ICOSL), B7-H3, B7-H4, CD28, CTLA4, TCR, PD1, CD80, or ICOS.

According to one embodiment, an MRD-containing antibody is administered in combination with a compound that regulates cell cycling, cell division or mitosis. In some embodiments, the MRD-containing antibody is administered in combination with a compound that antagonizes or reduces the activity of: PI3K, SMO, Ptch, HH, SHH, plk1, plk2, plk3, plk4, aurora A, aurora B, aurora C, CDK1, CDK2, CDK4, CHK1, CHK2, GSK3B, PAK, NEK2A, ROCK 2, MDM2, EGF (KSP), proteasome 20S, HDAC, or survivin.

According to one embodiment, an MRD-containing antibody is administered in combination with a compound that regulates DNA replication or repair. In some embodiments, the MRD-containing antibody is administered in combination with a compound that antagonizes or reduces the activity of: BRCA1, CHK1, CHK2, E2F, E2FL, MDM2, MDM4, or PARP1.

According to one embodiment, an MRD-containing antibody is administered in combination with a compound that regulates transcription or translation. In some embodiments, the MRD-containing antibody is administered in combination with a compound that antagonizes or reduces the activity of: IGF1R, IGF1, IGF2, PDGFRA, PDGFRB, PDGF-A, PDGF-B, PDGF-CC, PDGF-C, PDGF-D, KIT, MYC, CD28, CDK4, CDK6, mTOR, MDM2, HDAC, E2F, E2F1, or HIF1.

According to one embodiment, an MRD-containing antibody is administered in combination with a compound that regulates migration, invasion or metastasis. In some embodiments, the MRD-containing antibody is administered in combination with a compound that inhibits or reduces the activity of: c-MET, RON, CXCR4, PI3K, AKT, MMP2, FN1, CATHD, AMF, αvβ1 integrin, αvβ3 integrin, αvβ5 integrin, TGFb, α1β1 integrin, α2β1 integrin, α4β1 integrin, α2β1 integrin, α5β1 integrin, α9β1 integrin, α6β4 integrin, αMβ2 integrin, or HIF1.

According to one embodiment, an MRD-containing antibody is administered in combination with a compound that regulates cell metabolism. In some embodiments, the MRD-containing antibody is administered in combination with a compound that inhibits or reduces the activity of: ErbB2, EGFR, IGF1R, IGF1, IGF2, TGFa, ICOS, PI3K, VEGFR1, VEGFR2, mTOR, HIF1, or HDAC.

According to one embodiment, an MRD-containing antibody is administered in combination with an inhibitor of one or more protein kinases. In one embodiment, the protein kinase inhibitor inhibits a target of the MRD containing antibody (e.g., by either one or more MRDs or the antibody of the MRD containing antibody). In an alternative embodiment, the protein kinase inhibitor inhibits a protein kinase that is not a target of the MRD containing antibody. In some embodiments, the protein kinase inhibitor inhibits one protein kinase. In other embodiments, the protein kinase inhibitor inhibits more than one protein kinase.

In some embodiments, an MRD containing antibody is administered in combination with an inhibitor (e.g., small molecule, antibody, etc.,) of a protein kinase selected from: EGFR, FGFR1 (e.g., FGFR1-IIIC), FGFR2 (e.g., FGFR2-IIIa, FGFR2-IIIb, and FGFR2-IIIb), FGFR3, ErbB2, VEGFR1, VEGFR2, VEGFR3, Tie-2, PDGFR, PDGFRB, RON, and c-Met. In other embodiments, the inhibitor inhibits a protein kinase that is not targeted by the MRD containing antibody. In an additional embodiment, an MRD-containing antibody is administered in combination with an inhibitor of one or more protein kinases selected from: EGFR, FGFR1 (e.g., FGFR1-IIIC), FGFR2 (e.g., FGFR2-IIIa, FGFR2-IIIb, and FGFR2-IIIb), FGFR3, ErbB2, VEGFR1, VEGFR2, VEGFR3, Tie-2, PDGFRA, PDGFRB, FIT3, ALK, RET, Kit, raf, p38, RON, c-Met, PI3K, ERK, FAK, AKT, SYK, JAK1, JAK2, JAK3, TYK2, SIP, FAK, PTK7, PKD1, PKA, PKC, PKG, PRKDC, Pim, CDK, plk, p38MAPK, SRC, ABL, FGR, FYN, HCK, LCK, LYN, YES, EPH4, BMK1, ERK5, mTOR, CHK1, CHK2, CSNK1G1, CSNK1G2, CSNK1G3, GSK3, BTK, JNK, Aurora Kinase, Aurora Kinase A, Aurora Kinase B, and Aurora Kinase C.

In an additional embodiment, an MRD-containing antibody is administered in combination with a protein kinase inhibitor selected from: imatinib mesylate (e.g., GLEEVEC™), gefitinib (e.g., IRESSA™, Astra Zeneca), vandetanib (e.g., ZACTIMA™, Astra Zeneca), erlotinib (e.g., TARCEVA™, Genentech/OSI), sunitinib (e.g., SUTENT™, Pfizer), lapatanib (GSK), and sorafenib (e.g., NEXAVAR™, Bayer).

In a further embodiment, an MRD-containing antibody is administered in combination with a protein kinase inhibitor selected from: nilotinib (e.g., AMN107, Novartis), dasatinib (e.g., BMS 354825, BMS), ABT-869, botsutinib (e.g., SKI-606, Wyeth), cediranib, recentib, captastatin, AEE788 (Novartis), AZD0530 (AstraZeneca) Exel 7646/Exel 0999 Exelixis), cabozantinib (e.g., XL184; Exelixis), XL880/GSK1363089 (Exelixis/GSK), ARQ-197 (Arqule and Daiichi Sankyo), Inno-406 (Innovive), SGS523 (SGX), PF-2341066 (Pfizer), CI-1033 (Pfizer), motesanib (e.g., AMG-706, Amgen), AG-013736 (Axitinib), AMG-705 (Amgen), pegaptanib (OSI/Pfizer), lestaurtinib, ruxolitinib, SB1518, CYT387, LY3009104, TG101348 JANEX-1, tofacitinib (Pfizer), INCB18424, LFM-A13, pazopanib (e.g., GW786034B, GlaxoSmithKline), GW-572016, EKB-569

(Wyeth-Ayerst), vatalanib (e.g., PTK787/ZK), AZD2171, MK-0457 (VX-680, Merck), PHA 739358 (Nerviano), mubritinib (Takeda), E7080 (Eisai), fostamatinib (Rigel/AstraZeneca), SGX523, SNS-032 (Sunesis), XL143, SNS-314 (Sunesis), SU6668 (Pfizer), AV-951 (AVEO), AV-412 (AVEO), tivizanib (AVEO), PX-866 (Oncothyreon), canertinib (CI-1033), NSC 109555, VRX0466617, UCN-01, CHK2 inhibitor II, EXEL-9844, XL844, CBP501, PF-004777736, debromohymerialdisine, Go6976, AEG3482, cediranib (e.g., RECENTIN™, AstraZeneca), semaxanib (SU5416), SU5616, CGP, 53716, mastinib, and ZD6474 (AstraZeneca).

In a further embodiment, an MRD-containing antibody is administered in combination with a FGFR protein kinase inhibitor selected from: sunitinib, SU5402, PD173074, TKI258 (Novartis), BIBF 1120 (Boehringer Ingelheim), brivanib (BMS-582,664), E7080 (Eisai), and TSU-68 (Taiho).

In an additional embodiment, an MRD-containing antibody is administered in combination with a protein kinase inhibitor of JAK1, JAK2, JAK3, or SYK. In a further embodiment the protein kinase inhibitor is selected from: lestaurtinib, tofacitinib, ruxolitinib, SB1518, CYT387, LY3009104, TG101348, fostamatinib, BAY 61-3606, and sunitinib.

In one embodiment, an ErbB2 (HER2) binding MRD-containing antibody (e.g., an MRD-binding antibody that binds ErbB2 by either one or more MRDs or the antibody of the MRD containing antibody) is administered in combination with a protein kinase inhibitor of ErbB2. In another specific embodiment a trastuzumab antibody-based MRD-containing antibody is administered in combination with a protein kinase inhibitor of ErbB2. In one embodiment, an ErbB2-binding MRD-containing antibody is administered in combination with lapatinib. In a specific embodiment a trastuzumab antibody-based MRD-containing antibody is administered in combination with lapatinib. In one embodiment, an ErbB2-binding MRD-containing antibody is administered in combination with sunitinib. In a specific embodiment a trastuzumab antibody-based MRD-containing antibody is administered in combination with sunitinib. In one embodiment, an ErbB2-binding MRD-containing antibody is administered in combination with neratinib. In a specific embodiment a trastuzumab antibody-based MRD-containing antibody is administered in combination with neratanib. In one embodiment, an ErbB2-binding MRD-containing antibody is administered in combination with iapatinib. In a specific embodiment a trastuzumab antibody-based MRD-containing antibody is administered in combination with iapatinib. In an additional embodiment, an ErbB2 (HER2) binding MRD-containing antibody is administered in combination with a protein kinase inhibitor selected from: canertinib (GW-572016), AV-412 (AVEO), tivozanib (AVEO), vandetanib (e.g., ZACTIMA™, AstraZeneca), AEE788 (Novartis), Exel 7646/Exel 0999 (Exelixis), CI-1033 (Pfizer), and EKB-569 (Wyeth-Ayerst). In a specific embodiment a trastuzumab antibody-based MRD-containing antibody is administered in combination with a protein kinase inhibitor selected from: canertinib (GW-572016), AV-412 (AVEO), tivozanib (AVEO), vandetanib (e.g., ZACTIMA™, AstraZeneca), AEE788 (Novartis), Exel 7646/Exel 0999 (Exelixis), CI-1033 (Pfizer), PX-866 (Oncothyreon), and EKB-569 (Wyeth-Ayerst).

In another embodiment, an EGFR binding MRD-containing antibody (e.g., an MRD-binding antibody that binds EGFR by either one or more MRDs or the antibody of the MRD containing antibody) is administered in combination with a protein kinase inhibitor of EGFR. In a specific embodiment a cetuximab antibody-based MRD-containing antibody is administered in combination with a protein kinase inhibitor of EGFR. In one embodiment, an EGFR binding MRD-containing antibody is administered in combination with gefitinib (e.g., IRESSA™, AstraZeneca). In a specific embodiment a cetuximab antibody-based MRD-containing antibody is administered in combination with gefitinib (e.g., IRESSA™, AstraZeneca). In one embodiment, an EGFR binding MRD-containing antibody is administered in combination with erlotinib (e.g., TARCEVA™, Genentech/OSI). In a specific embodiment a cetuximab antibody-based MRD-containing antibody is administered in combination with erlotinib (e.g., TARCEVA™, Genentech/OSI). In one embodiment, an EGFR binding MRD-containing antibody is administered in combination with lapatinib. In a specific embodiment a cetuximab antibody-based MRD-containing antibody is administered in combination with lapatinib. In one embodiment, an EGFR binding MRD-containing antibody is administered in combination with sorafenib (e.g., NEXAVAR™, Bayer). In a specific embodiment a cetuximab antibody-based MRD-containing antibody is administered in combination with sorafenib (e.g., NEXAVAR™, Bayer). In another embodiment, an EGFR binding MRD-containing antibody is administered in combination with a protein kinase inhibitor selected from: canertinib (GW-572016), ZD6474, AV-412 (AVEO), tivozanib (AVEO), vandetanib (ZACTIMA, AstraZeneca), AEE788 (Novartis), Exel 7646/Exel 0999 (Exelixis), CI-1033 (Pfizer), and EKB-569 (Wyeth-Ayerst). In a specific embodiment a cetuximab antibody-based MRD-containing antibody is administered in combination with a protein kinase inhibitor selected from: canertinib (GW-572016), ZD6474, AV-412 (AVEO), tivozanib (AVEO), vandetanib (ZACTIMA, AstraZeneca), AEE788 (Novartis), Exel 7646/Exel 0999 (Exelixis), CI-1033 (Pfizer), PX-866 (Oncothyreon), and EKB-569 (Wyeth-Ayerst).

In one embodiment, a VEGFA, VEGFR1, or VEGFR2 binding MRD-containing antibody (e.g., an MRD-binding antibody that binds VEGFR1 by either one or more MRDs or the antibody of the MRD containing antibody) is administered in combination with a protein kinase inhibitor of VEGR1, VEGFR2, or VEGFR3. In one embodiment, the VEGFA, VEGFR1 or VEGFRr2 binding MRD-containing antibody is administered in combination with: sunitinib, sorafenib, pazopanib (e.g., GW786034B), AZD2171, vatalanib, ZD6474, AMG-706, or AC013736.

In a further embodiment, an MRD-containing antibody is administered in combination with a proteasome inhibitor. In a specific embodiment, the inhibitor is bortezomib (e.g., VELCADE™). In another specific embodiment, the inhibitor is PR-171 (Proteolix).

In a further embodiment, an MRD-containing antibody is administered in combination with a HDAC inhibitor.

In a further embodiment, an MRD-containing antibody is administered in combination with a mTOR inhibitor.

In a further embodiment, an MRD-containing antibody is administered in combination with a NFKB inhibitor.

In one embodiment, the invention provides a method of treating cancer comprising administering a therapeutically effective amount of a VEGFA or VEGFR binding MRD-containing antibody to a patient in need thereof. In a specific embodiment, the invention provides a method of treating cancer comprising administering a therapeutically effective amount of bevacizumab comprising at least one MRD to a patient in need thereof. In one embodiment, the invention provides a method of treating colorectal cancer by administering a therapeutically effective amount of bevacizumab comprising at least one MRD to a patient having colorectal cancer. In another embodiment, the invention provides a method of treating breast cancer by administering a therapeutically effective amount of bevacizumab comprising at least one MRD to a patient having breast cancer. In another embodiment, the invention provides a method of treating non-small cell lung carcinoma by administering a therapeutically effective amount of bevacizumab comprising at least one MRD to a patient having non-small cell lung carcinoma. In other embodiments, therapeutic effective amounts of bevacizumab comprising at least one MRD are administered to a patient to treat metastatic colorectal cancer, metastatic breast cancer, metastatic pancreatic cancer, or metastatic non-small cell lung carcinoma. In another embodiment, the invention provides a method of treating cancer by administering to a patient a therapeutically effective amount of bevacizumab comprising at least one MRD to a patient having renal cell carcinoma, glioblastoma multiforme, ovarian cancer, prostate cancer, liver cancer or pancreatic cancer.

Combination therapy and compositions including multivalent and multispecific compositions (e.g., MRD-containing antibodies) of the invention and another therapeutic are also encompassed by the invention, as are methods of treatment using these compositions. In other embodiments, compositions of the invention are administered alone or in combination with one or more additional therapeutic agents. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the therapeutic compounds or agents given first, followed by the second. Accordingly, in one embodiment, a VEGFA or VEGFR binding MRD-containing antibody is administered in combination with 5-fluorouracil, carboplatin, paclitaxel, or interferon alpha. In another embodiment, bevacizumab comprising at least one MRD is administered in combination with 5-fluorouracil, carboplatin, paclitaxel, or interferon alpha.

In another embodiment, the invention provides a method of treating macular degeneration comprising administering a therapeutically effective amount of a VEGFA or VEGFR binding MRD-containing antibody to a patient in need thereof. In a specific embodiment, the invention provides a method of treating macular degeneration comprising administering a therapeutically effective amount of bevacizumab comprising at least one MRD to a patient in need thereof. In a specific embodiment, the invention provides a method of treating macular degeneration comprising administering a therapeutically effective amount of ranibizumab comprising at least one MRD to a patient in need thereof.

In some embodiments, the invention provides a method of treating cancer comprising administering a therapeutically effective amount of an ErbB2 (HER2) binding MRD-containing antibody to a patient in need thereof. In various embodiments, the ErbB2-binding multivalent and multispecific compositions (e.g., MRD-containing antibodies) are administered to patients who have been previously shown to respond to another ErbB2-based therapy (e.g., HERCEPTIN, chemotherapy and/or radiation) or are predicted to respond to another ErbB2-based therapy. In other embodiments, the ErbB2-binding multivalent and multispecific compositions (e.g., MRD-containing antibodies) are administered to patients who have previously failed to respond to another ErbB2-based therapy or are predicted to fail to respond to another ErbB2-based therapy.

In a specific embodiment, the invention provides a method of treating cancer comprising administering a therapeutically effective amount of trastuzumab comprising at least one MRD to a patient in need thereof. In one embodiment, the invention provides a method of treating breast cancer by administering a therapeutically effective amount of trastuzumab comprising at least one MRD to a patient having breast cancer. In other embodiments, therapeutic effective amounts of trastuzumab comprising at least one MRD are administered to a patient to treat metastatic breast cancer.

In another embodiment, an ErbB2 (HER2) binding MRD-containing antibody is administered in combination with cyclophosphamide, paclitaxel, docetaxel, carboplatin, anthracycline, or a maytansinoid. In a specific embodiment, trastuzumab comprising at least one MRD is administered in combination with cyclophosphamide, paclitaxel, docetaxel, carboplatin, anthracycline, or a maytansinoid.

In another embodiment, the invention provides a method of treating cancer comprising administering a therapeutically effective amount of a CD20-binding MRD-containing antibody to a patient in need thereof. In a specific embodiment, the invention provides a method of treating a hematologic cancer comprising administering a therapeutically effective amount of rituximab comprising at least one MRD to a patient in need thereof. In one embodiment, the invention provides a method of treating CD20 positive NHL by administering a therapeutically effective amount of bevacizumab comprising at least one MRD to a patient having CD20 positive NHL. In one embodiment, the invention provides a method of treating CD20 positive CLL by administering a therapeutically effective amount of bevacizumab comprising at least one MRD to a patient having CD20 positive CLL.

In another embodiments, a therapeutically effective amount of a CD20-binding MRD-containing antibody is administered in combination with: ludarabine, cyclophosphamide, FC (fludarabine and cyclophosphamide), anthracycline based chemotherapy regimen (e.g., CHOP (cyclophosphamide, adriamycin, vincristine and prednisone)), or CVP (cyclophosphamide, prednisone, and vincristine) chemotherapy. In a specific embodiment, a therapeutically effective amount of bevacizumab comprising at least one MRD is administered in combination with: ludarabine, cyclophosphamide, FC (fludarabine and cyclophosphamide), anthracycline based chemotherapy regimen (e.g., CHOP (cyclophosphamide, adriamycin, vincristine and prednisone)), or CVP (cyclophosphamide, prednisone, and vincristine) chemotherapy.

Any of the antibody-MRD fusions containing antibodies and/or MRDs that bind CD20 can be used according to the methods of treating a disorder associated with CD20, or that can be treated by targeting cells that express CD20 (e.g., hematological cancers and autoimmune disease). In some embodiments, the antibody component of the antibody-MRD-fusion is selected from rituximab, ocrelizumab, GA101, and PF-5,230,895.

The invention also provides a method of treating a disorder of the immune system comprising administering a therapeutically effective amount of an MRD-containing antibody. In some embodiments, the administered MRD-containing antibody binds a target selected from: CD20, TNFRSF5 (CD40), CD45RB, CD52, CD200, CCR2, PAFR, IL6R, TNFRSF1A, VLA4, CSF2, TNFSF5 (CD40

LIGAND), TLR2, TLR4, GPR44, FASL, TREM1, IL1, IL1 beta, IL1RN, tissue factor, MIF, M1P2, 1L6, 1L8, IL10, 1L12, IL13, IL15, IL17, IL18, IL23, TNF, TNFSF12 (TWEAK), LPS, CXCL13, VEGF, IFN alpha, IFN gamma, GMCSF, FGF, TGFb, C5, and CCR3. Multivalent and multispecific compositions (e.g., MRD-containing antibodies) that bind 2, 3, 4, 5 or more of these targets are also encompassed by the invention.

In particular embodiments, the invention provides a method of treating a disorder of the immune system comprising administering a therapeutically effective amount of an MRD-containing antibody that binds TNF and ANG2.

In additional embodiments, the invention provides a method of treating a disorder of the immune system comprising administering a therapeutically effective amount of an MRD-containing antibody that binds IL1, IL12, and TNF. In further embodiments, the MRD-containing antibody binds IL1, IL12, TNF and ANG2.

In additional embodiments, the administered MRD-containing antibody binds IL1, IL6 and TNF. In further embodiments, the MRD-containing antibody binds IL1, IL6, TNF and ANG2.

target selected from: CD20, TNFRSF5 (CD40), CD45RB, CD52, CD200, CCR2, PAFR, IL6R, TNFRSF1A, VLA4, CSF2, TNFSF5 (CD40 LIGAND), TLR2, TLR4, GPR44, FASL, TREM1, IL1, IL1 beta, IL1RN, tissue factor, MIF, MIP2, IL6, IL8, IL10, IL12, IL13, IL15, IL17, IL18, IL23, TNF, TNFSF12 (TWEAK), LPS, CXCL13, VEGF, IFN alpha, IFN gamma, GMCSF, FGF, TGFb, C5, and CCR3. Multivalent and multispecific compositions (e.g., MRD-containing antibodies) that bind 2, 3, 4, 5 or more of these targets are also encompassed by the invention.

In additional embodiments, the invention provides a method of treating an autoimmune disease comprising administering a therapeutically effective amount of an MRD-containing antibody. In a specific embodiment, the administered MRD-containing antibody binds a target selected from: CD1C, CD3, CD4, CD19, CD20, CD21, CD22, CD23, CD24, CD28, CD37, CD38, CD45RB, CD52, CD69, CD72, CD74, CD75, CD79A, CD79B, CD80, CD81, CD83, CD86, CD200, IL2RA, IL1R2, IL6R, VLA4, HLA-DRA, HLA-A, ITGA2, ITGA3, CSF2, TLR2, TLR4, GPR44, TREM1, TIE2, TNF, FASL, tissue factor, MIF, MIP2, IL1, IL1 beta, IL1RN, IL2, IL4, IL6, IL8, IL10, IL11, IL12, IL13, IL15, IL17, IL18, IL23, TNFRSF1A, TNFRSF5 (CD40), TNFRSF6 (Fas, CD95), TNFRSF7 (CD27), TNFRSF8 (CD30), TNFRSF13C (BAFFR), TNFSF5 (CD40 Ligand), TNFSF6 (Fas Ligand), TNFSF8 (CD30 Ligand), TNFSF12 (TWEAK), TNFSF13B (BLyS), ANG2, ICOSL (B7-H2), MS4A1, IFN alpha, IFN beta1, IFN gamma, TNFSF7 (CD27 Ligand, CD70), PAFR, INHA, INHBA, DPP4, NT5E, CTLA4, B7.1/B7.2, LPS, VEGF, GMCSF, FGF, C5, CXCL13, CXCR4, CCR2 and CCR3. In further embodiments, the multivalent and multispecific compositions (e.g., MRD-containing antibodies) are administered to treat rheumatoid arthritis and the multivalent and multispecific compositions bind a target selected from: CD19, CD20, CD45RB, CD52CD200, IL1, IL6, IL12, IL15, IL17, IL18, IL23, TNF, TNFSF12 (TWEAK), TNFRSF5 (CD40), TNFSF5 (CD40 Ligand), TNFSF13B (BLyS), VEGF, VLA4, IFN gamma, IFN alpha, GMCSF, FGF, C5, CXCL13 and CCR2. In additional embodiments, the multivalent and multispecific compositions (e.g., MRD-containing antibodies) are administered to treat systemic lupus erythematous and the multivalent and multispecific compositions bind IFN alpha and TNFSF13B (BLyS). In further embodiments, the multivalent and multispecific compositions (e.g., MRD-containing antibodies) are administered to treat multiple sclerosis and the multivalent and multispecific compositions bind a target selected from: ANG2, IL1, IL12, IL18, IL23, CXCL13, TNF, TNFRSF5 (CD40), TNFSF5 (CD40 Ligand), VEGF, VLA4, TNF, CD45RB, CD200, IFN gamma, GM-CSF, FGF, C5, CD52, TNFRSF1A, TNFRSF5 (CD40), TNFRSF6 (Fas, CD95), TNFRSF7 (CD27), TNFRSF8 (CD30), TNFSF12 (TWEAK), TNFRSF13C (BAFFR), TNFSF5 (CD40 Ligand), TNFSF6 (Fas Ligand), TNFSF8 (CD30 Ligand), TNFRSF21 (DR6), TNFSF12 (TWEAK), TNFSF13B (BLyS), ANG2, AGE (S100 A, amphoterin), ICOSL (B7-H2), MS4A 1, IFN alpha, IFN beta1, IFN gamma, TNFSF7 (CD27 Ligand, CD70), MCP1, CCR2 and CXCL13. Multivalent and multispecific compositions that bind at least 2, 3, 4, 5 or more of these targets are also encompassed by the invention.

In a further embodiment, the invention provides a method of treating a disorder of the immune system comprising administering a therapeutically effective amount of a CD20-binding MRD-containing antibody to a patient in need thereof. In a specific embodiment, the invention provides a method of treating an autoimmune disease comprising administering a therapeutically effective amount of a CD20-binding MRD-containing antibody to a patient in need thereof. In one embodiment, the invention provides a method of treating an autoimmune disease comprising administering a therapeutically effective amount of a rituximab-MRD-containing antibody to a patient in need thereof. In another embodiment, the invention provides a method of treating rheumatoid arthritis comprising administering a therapeutically effective amount of a rituximab-MRD-containing antibody to a patient in need thereof. In another embodiment, the invention provides a method of treating systemic lupus erythematous comprising administering a therapeutically effective amount of a rituximab-MRD-containing antibody to a patient in need thereof. In another embodiment, the invention provides a method of treating multiple sclerosis comprising administering a therapeutically effective amount of a rituximab-MRD-containing antibody to a patient in need thereof.

In an additional embodiment, the invention provides a method of treating an autoimmune disease comprising administering a therapeutically effective amount of an ocrelizumab-MRD-containing antibody to a patient in need thereof. In one embodiment, the invention provides a method of treating rheumatoid arthritis comprising administering a therapeutically effective amount of an ocrelizumab-MRD-containing antibody to a patient in need thereof. In a further embodiment, the invention provides a method of treating systemic lupus erythematous comprising administering a therapeutically effective amount of a ocrelizumab-MRD-containing antibody to a patient in need thereof. In another embodiment, the invention provides a method of treating multiple sclerosis comprising administering a therapeutically effective amount of an ocrelizumab-MRD-containing antibody to a patient in need thereof.

In another embodiment, the invention provides a method of treating an autoimmune disease comprising administering a therapeutically effective amount of a PF5,230,895-MRD-containing antibody to a patient in need thereof. In one embodiment, the invention provides a method of treating rheumatoid arthritis comprising administering a therapeutically effective amount of a PF5,230,895-MRD-containing antibody to a patient in need thereof. In a further embodiment, the invention provides a method of treating systemic lupus erythematous comprising administering a therapeutically effective amount of a PF5,230,895-MRD-containing antibody to a patient in need thereof. In another embodiment, the invention provides a method of treating multiple sclerosis comprising administering a therapeutically effective amount of an PF5,230,895-MRD-containing antibody to a patient in need thereof.

In some embodiments, the invention provides a method of treating a disorder of the immune system comprising administering a therapeutically effective amount of an MRD-containing antibody that binds CD20. In further embodiments, the administered MRD-containing antibody binds CD20 and a target selected from: TNF, TNFRSF5 (CD40), TNFSF5 (CD40 LIGAND), TNFSF12 (TWEAK), TNFRSF1A, CD45, RB, CD52, CD200, CCR2, PAFR, IL6R, VLA4, CSF2, RAGE, TLR2, TLR4, GPR44, FASL, TREM1, TIE2, tissue factor, MIF, MIP2, LPS, IL1, IL1 beta, IL1RN, IL6, IL6R, IL8, IL10, IL12, IL13, IL15, IL17, IL18, IL23, CXCL13, VEGF, IFN alpha, IFN gamma, GMCSF, FGF, C5, and CCR3. Multivalent and multispecific compositions (e.g., MRD-containing antibodies) that bind CD20 and also bind at least 1, 2, 3, 4, 5 or more of these targets are also encompassed by the invention. In specific embodiments, the antibody component of the MRD-containing antibody binds CD20. In further embodiments, the antibody component of the MRD-containing antibody is a rituximab, ocrelizumab, GA101 or PF-5,230,895.

In some embodiments, the invention provides a method of treating an autoimmune disease comprising administering a therapeutically effective amount of an MRD-containing antibody that binds CD20. In a specific embodiment, the administered MRD-containing antibody binds CD20 and a target selected from: CD1C, CD3, CD4, CD19, CD21, CD22, CD23, CD24, CD28, CD37, CD38, CD45RB, CD52, CD69, CD72, CD74, CD75, CD79A, CD79B, CD80, CD81, CD83, CD86, CD200, IL2RA, IL1R2, IL6R, VLA4, HLA-DRA, HLA-A, ITGA2, ITGA3, CSF2, TLR2, TLR4, GPR44, TREM1, TIE2, TNF, FASL, tissue factor, MIF, MIP2, IL1, IL1 beta, IL1RN, IL2, IL4, IL6, IL8, IL10, IL11, IL12, IL13, IL15, IL17, IL18, IL23, TIE2, TNFRSF1A, TNFRSF5 (CD40), TNFRSF6 (Fas, CD95), TNFRSF7 (CD27), TNFRSF8 (CD30), TNFRSF13C (BAFFR), TNFSF5 (CD40 Ligand), TNFSF6 (Fas Ligand), TNFSF8 (CD30 Ligand), TNFSF12 (TWEAK), TNFSF13B (BLyS), ANG2, ICOSL (B7-H2), MS4A1, IFN alpha, IFN IFN gamma, TNFSF7 (CD27 Ligand, CD70), PAFR, INHA, INHBA, DPP4, NT5E, CTLA4, B7.1/B7.2, LPS, VEGF, GMCSF, FGF, C5, CXCL13, CXCR4, CCR2 and CCR3. In further embodiments, the multivalent and multispecific compositions (e.g., MRD-containing antibodies) are administered to treat rheumatoid arthritis and the multivalent and multispecific compositions bind CD20 and a target selected from: CD19, CD45RB, CD52, CD200, IL12, IL15, IL17, IL18, IL23, TNF, TNFSF12 (TWEAK), TNFRSF5 (CD40), TNFSF5 (CD40 Ligand), VEGF, VLA4, IFN gamma, interferon alpha, GMCSF, FGF, C5, CXCL13 and CCR2. In further embodiments, the multivalent and multispecific compositions (e.g., MRD-containing antibodies) are administered to treat multiple sclerosis and the multivalent and multispecific compositions bind CD20 and a target selected from: ANG2, 1L12, 1L18, 1L23, CXCL13, TNFRSF5 (CD40), TNFSF5 (CD40 Ligand), VEGF, VLA4, TNF, CD45RB, CD200, IFN gamma, GM-CSF, FGF, C5, CD52, TIE2, TNFRSF1A, TNFRSF5 (CD40), TNFRSF6 (Fas, CD95), TNFRSF7 (CD27), TNFRSF8 (CD30), TNFSF12 (TWEAK), TNFRSF13C (BAFFR), TNFSF5 (CD40 Ligand), TNFSF6 (Fas Ligand), TNFSF8 (CD30 Ligand), TNFRSF21 (DR6), TNFSF12 (TWEAK), TNFSF13B (BLyS), ICOSL (B7-H2), MS4A 1, IFN alpha, IFN beta1, IFN gamma, TNFSF7 (CD27 Ligand, CD70), CCR2 and CXCL13. Multivalent and multispecific compositions that bind a least 1, 2, 3, 4, 5 or more of these targets are also encompassed by the invention. In specific embodiments, the antibody component of the MRD-containing antibody binds TNF. In further embodiments, the antibody component of the MRD-containing antibody is selected from rituximab, ocrelizumab, GA101 and PF-5,230,895.

In some embodiments, the invention provides a method of treating a disorder of the immune system comprising administering a therapeutically effective amount of a TNF-binding MRD-containing antibody to a patient in need thereof. In various embodiments, the TNF-binding multivalent and multispecific compositions (e.g., MRD-containing antibodies) are administered to patients who have been previously shown to respond to another TNF-based therapy or are predicted to respond to another TNF-based therapy (e.g., TNF antagonists such as, anti-TNFs (e.g., HUMIRA), EMBREL, CD28 antagonists, CD20 antagonists, and IL6/1L6R antagonists). In other embodiments, the TNF-binding multivalent and multispecific compositions (e.g., MRD-containing antibodies) are administered to patients who have previously failed to respond to another TNF-based therapy or are predicted to fail to respond to another TNF-based therapy.

In some embodiments, the invention provides a method of treating a disorder of the immune system comprising administering a therapeutically effective amount of an MRD-containing antibody that binds TNF.

In further embodiments, the administered MRD-containing antibody binds TNF and a target selected from: CD20, TNFRSF5 (CD40), CD45RB, CD52, CD200, CCR2, PAFR, IL6R, TNFRSF1A, VLA4, CSF2, TNFSF5 (CD40 LIGAND), TLR2, TLR4, GPR44, FASL, TREM1, IL1, IL1 beta, IL1RN, tissue factor, MIF, MIP2, IL6, IL8, IL10, IL12, IL13, IL15, IL17, IL18, IL23, TNFSF12 (TWEAK), LPS, CXCL13, VEGF, IFN gamma, GMCSF, FGF, C5, and CCR3. Multivalent and multispecific compositions (e.g., MRD-containing antibodies) that bind TNF and at least 1, 2, 3, 4, 5 or more of these targets are also encompassed by the invention. In specific embodiments, the antibody component of the MRD-containing antibody binds TNF. In further embodiments, the antibody component of the MRD-containing antibody is selected from adalimumab, certolizumab, golimumab and AME-527.

In some embodiments, the invention provides a method of treating an autoimmune disease comprising administering a therapeutically effective amount of an MRD-containing antibody that binds TNF. In a specific embodiment, the administered MRD-containing antibody binds TNF and a target selected from: CD1C, CD3, CD4, CD19, CD20, CD21, CD22, CD23, CD24, CD28, CD37, CD38, CD45RB, CD52, CD69, CD72, CD74, CD75, CD79A, CD79B, CD80, CD81, CD83, CD86, CD200, IL2RA, IL1R2, IL6R, VLA4, HLA-DRA, HLA-A, ITGA2, ITGA3, CSF2, TLR2, TLR4, GPR44, TREM1, TIE2, FASL, tissue factor, MIF, MIP2, IL1, IL1 beta, IL1RN, IL2, 1L4, IL6, IL8, IL10, IL11, IL12, IL13, IL15, IL17, IL18, IL23, TIE2, TNFRSF1A, TNFRSF5 (CD40), TNFRSF6 (Fas, CD95), TNFRSF7 (CD27), TNFRSF8 (CD30), TNFRSF13C (BAFFR), TNFSF5 (CD40 Ligand), TNFSF6 (Fas Ligand), TNFSF8 (CD30 Ligand), TNFSF12 (TWEAK), TNFSF13B (BLyS), ANG2, ICOSL (B7-H2), MS4A1, IFN alpha, IFN beta1, IFN gamma, TNFSF7 (CD27 Ligand, CD70), PAFR, INHA, INHBA, DPP4, NT5E, CTLA4, B7.1/B7.2, LPS, VEGF, GMCSF, FGF, C5, CXCL13, CXCR4, CCR2 and CCR3. In further embodiments, the multivalent and multispecific compositions (e.g., MRD-containing antibodies) are administered to treat rheumatoid arthritis and the multivalent and multispecific compositions bind TNF and a target selected from: CD19, CD20, CD45RB, CD52CD200, IL12, IL15, IL17, IL18, IL23, TNFSF12 (TWEAK), TNFRSF5 (CD40), TNFSF5 (CD40 Ligand), TNFSF13B (BLyS), VEGF, VLA4, IFN gamma, interferon alpha, GMCSF, FGF, C5, CXCL13 and CCR2. In further embodiments, the multivalent and multispecific compositions (e.g., MRD-containing antibodies) are administered to treat multiple sclerosis and the multivalent and multispecific compositions bind TNF and a target selected from: ANG2, IL12, IL18, IL23, CXCL13, TNFRSF5 (CD40), TNFSF5 (CD40 Ligand), VEGF, VLA4, TNF, CD45RB, CD200, IFN gamma, GM-CSF, FGF, C5, CD52, TNFRSF1A, TNFRSF5 (CD40), TIE2, TNFRSF6 (Fas, CD95), TNFRSF7 (CD27), TNFRSF8 (CD30), TNFSF12 (TWEAK), TNFRSF13C (BAFFR), TNFSF5 (CD40 Ligand), TNFSF6 (Fas Ligand), TNFSF8 (CD30 Ligand), TNFRSF21 (DR6), TNFSF12 (TWEAK), TNFSF13B (BLyS), ICOSL (B7-H2), MS4A 1, IFN alpha, IFN beta1, IFN gamma, TNFSF7 (CD27 Ligand, CD70), CCR2 and CXCL13. Multivalent and multispecific compositions that bind a least 1, 2, 3, 4, 5 or more of these targets are also encompassed by the invention. In specific embodiments, the antibody component of the MRD-containing antibody binds TNF. In further embodiments, the antibody component of the MRD-containing antibody selected from adalimumab, certolizumab, golimumab and AME-527.

In other embodiments, the TNF-binding multivalent and multispecific compositions (e.g., MRD-containing antibodies) are administered to patients who have been previously shown to respond to an autoimmune disease based therapy or are predicted to respond to other autoimmune disease based therapies (e.g., TNF antagonists such as, Anti-TNFs (e.g., HUMIRA®), ENBREL®, CD28 antagonists, CD20 antagonists, BLyS antagonists, and IL6/IL6R antagonists). In other embodiments, the TNF-binding multivalent and multispecific compositions (e.g., MRD-containing antibodies) are administered to patients who have previously failed to respond to another autoimmune disease based therapy or are predicted to fail to respond to another autoimmune disease based therapy.

In a specific embodiment, the invention provides a method of treating a disorder of the immune system comprising administering a therapeutically effective amount of adalimumab comprising at least one MRD to a patient in need thereof. In one embodiment, the invention provides a method of treating an autoimmune disease by administering a therapeutically effective amount of adalimumab comprising at least one MRD to a patient in need thereof. In one embodiment, the invention provides a method of treating rheumatoid arthritis, by administering a therapeutically effective amount of adalimumab comprising at least one MRD to a patient in need thereof. In one embodiment, the invention provides a method of treating an inflammatory disorder, by administering a therapeutically effective amount of adalimumab comprising at least one MRD to a patient in need thereof. In another embodiment, the invention provides a method of treating Crohn's disease, by administering a therapeutically effective amount of adalimumab comprising at least one MRD to a patient in need thereof. In another embodiment, the invention provides a method of treating ulcerative colitis, by administering a therapeutically effective amount of adalimumab comprising at least one MRD to a patient in need thereof. In another embodiment, the invention provides a method of treating psoriatic arthritis, ankylosing spondylitis, psoriasis, or juvenile idiopathic arthritis by administering a therapeutically effective amount of adalimumab comprising at least one MRD to a patient in need thereof.

In an additional embodiment, the invention provides a method of treating a disorder of the immune system comprising administering a therapeutically effective amount of ATN-103 comprising at least one MRD to a patient in need thereof. In one embodiment, the invention provides a method of treating an inflammatory disorder, by administering a therapeutically effective amount of ATN-103 comprising at least one MRD to a patient in need thereof. In another embodiment, the invention provides a method of treating an autoimmune disease, by administering a therapeutically effective amount of ATN-103 comprising at least one MRD to a patient in need thereof. In a further embodiment, the invention provides a method of treating rheumatoid arthritis, by administering a therapeutically effective amount of ATN-103 comprising at least one MRD to a patient in need thereof. In another embodiment, the invention provides a method of treating Crohn's disease, by administering a therapeutically effective amount of ATN-103 comprising at least one MRD to a patient in need thereof. In an additional embodiment, the invention provides a method of treating ulcerative colitis, by administering a therapeutically effective amount of ATN-103 comprising at least one MRD to a patient in need thereof. In another embodiment, the invention provides a method of treating psoriatic arthritis, ankylosing spondylitis, psoriasis, or juvenile idiopathic arthritis by administering a therapeutically effective amount of ATN-103 comprising at least one MRD to a patient in need thereof.

In a specific embodiment, the invention provides a method of treating a disorder of the immune system comprising administering a therapeutically effective amount of infliximab comprising at least one MRD to a patient in need thereof. In one embodiment, the invention provides a method of treating an inflammatory disorder, by administering a therapeutically effective amount of infliximab comprising at least one MRD to a patient in need thereof. In one embodiment, the invention provides a method of treating an autoimmune disease, by administering a therapeutically effective amount of infliximab comprising at least one MRD to a patient in need thereof. In one embodiment, the invention provides a method of treating rheumatoid arthritis, by administering a therapeutically effective amount of infliximab comprising at least one MRD to a patient in need thereof. In another embodiment, the invention provides a method of treating Crohn's disease, by administering a therapeutically effective amount of infliximab comprising at least one MRD to a patient in need thereof. In another embodiment, the invention provides a method of treating ulcerative colitis, by administering a therapeutically effective amount of infliximab comprising at least one MRD to a patient in need thereof. In another embodiment, the invention provides a method of treating psoriatic arthritis, ankylosing spondylitis, psoriasis, or juvenile idiopathic arthritis by administering a therapeutically effective amount of infliximab comprising at least one MRD to a patient in need thereof.

In some embodiments, the invention provides a method of treating a disorder of the immune system comprising administering a therapeutically effective amount of an MRD-containing antibody that binds TNFSF15 (TL1A).

In further embodiments, the administered MRD-containing antibody binds TL1A and a target selected from: TNF, IFN gamma, IL1, IL1beta, IL6, IL8, IL12, IL15, IL17, IL18, IL23 and IL32. Multivalent and multispecific compositions (e.g., MRD-containing antibodies) that bind TL1A and at least 1, 2, 3, 4, 5 or more of these targets are also encompassed by the invention. In specific embodiments, the antibody component of the MRD-containing antibody binds TL1A.

In an additional embodiment, the invention provides a method of treating a disorder of the immune system comprising administering a therapeutically effective amount of a IL22-binding MRD-containing antibody to a patient in need thereof. In a specific embodiment, the invention provides a method of treating a disorder of the immune system comprising administering a therapeutically effective amount of PF5,212,367 (ILV-094) comprising at least one MRD to a patient in need thereof. In one embodiment, the invention provides a method of treating an autoimmune disease by administering a therapeutically effective amount of PF5,212,367 comprising at least one MRD to a patient in need thereof. In one embodiment, the invention provides a method of treating rheumatoid arthritis, by administering a therapeutically effective amount of PF5,212,367 comprising at least one MRD to a patient in need thereof. In one embodiment, the invention provides a method of treating an inflammatory disorder, by administering a therapeutically effective amount of PF5,212,367 comprising at least one MRD to a patient in need thereof. In another embodiment, the invention provides a method of treating Crohn's disease, by administering a therapeutically effective amount of PF5,212,367 comprising at least one MRD to a patient in need thereof. In a further embodiment, the invention provides a method of treating ulcerative colitis, by administering a therapeutically effective amount of PF5,212,367 comprising at least one MRD to a patient in need thereof. In another embodiment, the invention provides a method of treating psoriatic arthritis, ankylosing spondylitis, psoriasis, or juvenile idiopathic arthritis by administering a therapeutically effective amount of PF5,212,367 comprising at least one MRD to a patient in need thereof.

In an additional embodiment, the invention provides a method of treating a disorder of the immune system comprising administering a therapeutically effective amount of a alpha4 integrin-binding MRD-containing antibody to a patient in need thereof. In a specific embodiment, the invention provides a method of treating a disorder of the immune system comprising administering a therapeutically effective amount of natalizumab comprising at least one MRD to a patient in need thereof. In one embodiment, the invention provides a method of treating an autoimmune disease by administering a therapeutically effective amount of natalizumab comprising at least one MRD to a patient in need thereof. In another embodiment, the invention provides a method of treating rheumatoid arthritis, by administering a therapeutically effective amount of natalizumab comprising at least one MRD to a patient in need thereof. In a further embodiment, the invention provides a method of treating systemic lupus erythematous comprising administering a therapeutically effective amount of a natalizumab-MRD-containing antibody to a patient in need thereof. In another embodiment, the invention provides a method of treating multiple sclerosis comprising administering a therapeutically effective amount of a natalizumab-MRD-containing antibody to a patient in need thereof. In a further embodiment, the invention provides a method of treating an inflammatory disorder, by administering a therapeutically effective amount of natalizumab comprising at least one MRD to a patient in need thereof. In another embodiment, the invention provides a method of treating Crohn's disease, by administering a therapeutically effective amount of natalizumab comprising at least one MRD to a patient in need thereof. In an additional embodiment, the invention provides a method of treating ulcerative colitis, by administering a therapeutically effective amount of natalizumab comprising at least one MRD to a patient in need thereof. In another embodiment, the invention provides a method of treating multiple sclerosis, by administering a therapeutically effective amount of natalizumab comprising at least one MRD to a patient in need thereof. In an additional embodiment, the invention provides a method of treating psoriatic arthritis, ankylosing spondylitis, psoriasis, or juvenile idiopathic arthritis by administering a therapeutically effective amount of natalizumab comprising at least one MRD to a patient in need thereof.

In an additional embodiment, the invention provides a method of treating a disorder of the immune system comprising administering a therapeutically effective amount of a TNFSF5 (CD40 LIGAND)-binding MRD-containing antibody to a patient in need thereof. In a specific embodiment, the invention provides a method of treating a disorder of the immune system comprising administering a therapeutically effective amount of CDP7657 comprising at least one MRD to a patient in need thereof. In one embodiment, the invention provides a method of treating an autoimmune disease by administering a therapeutically effective amount of CDP7657 comprising at least one MRD to a patient in need thereof. In another embodiment, the invention provides a method of treating rheumatoid arthritis, by administering a therapeutically effective amount of CDP7657 comprising at least one MRD to a patient in need thereof. In a further embodiment, the invention provides a method of treating systemic lupus erythematous comprising administering a therapeutically effective amount of a CDP7657-MRD-containing antibody to a patient in need thereof. In another embodiment, the invention provides a method of treating multiple sclerosis comprising administering a therapeutically effective amount of a CDP7657-MRD-containing antibody to a patient in need thereof. In one embodiment, the invention provides a method of treating an inflammatory disorder, by administering a therapeutically effective amount of CDP7657 comprising at least one MRD to a patient in need thereof. In another embodiment, the invention provides a method of treating Crohn's disease, by administering a therapeutically effective amount of CDP7657 comprising at least one MRD to a patient in need thereof. In a further embodiment, the invention provides a method of treating ulcerative colitis, by administering a therapeutically effective amount of CDP7657 comprising at least one MRD to a patient in need thereof. In an additional embodiment, the invention provides a method of treating psoriatic arthritis, ankylosing spondylitis, psoriasis, or juvenile idiopathic arthritis by administering a therapeutically effective amount of CDP7657 comprising at least one MRD to a patient in need thereof.

In another embodiment, the invention provides a method of treating a disorder of the immune system comprising administering a therapeutically effective amount of a TNFSF12 (TWEAK)-binding MRD-containing antibody to a patient in need thereof. In a specific embodiment, the invention provides a method of treating a disorder of the immune system comprising administering a therapeutically effective amount of the Biogen TNFSF12 (TWEAK) antibody (that has entered phase 1 clinical trials) comprising at least one MRD to a patient in need thereof. In one embodiment, the invention provides a method of treating an autoimmune disease by administering a therapeutically effective amount of the Biogen TNFSF12 (TWEAK) antibody comprising at least one MRD to a patient in need thereof. In one embodiment, the invention provides a method of treating rheumatoid arthritis, by administering a therapeutically effective amount of the Biogen TNFSF12 (TWEAK) antibody comprising at least one MRD to a patient in need thereof. In a further embodiment, the invention provides a method of treating systemic lupus erythematous comprising administering a therapeutically effective amount of the Biogen TNFSF12 (TWEAK) antibody comprising at least one MRD to a patient in need thereof. In another embodiment, the invention provides a method of treating multiple sclerosis comprising administering a therapeutically effective amount of the Biogen TNFSF12 (TWEAK) antibody comprising at least one MRD to a patient in need thereof. In another embodiment, the invention provides a method of treating an inflammatory disorder, by administering a therapeutically effective amount of the Biogen TNFSF12 (TWEAK) antibody comprising at least one MRD to a patient in need thereof. In an additional embodiment, the invention provides a method of treating Crohn's disease, by administering a therapeutically effective amount of the Biogen TNFSF12 (TWEAK) antibody comprising at least one MRD to a patient in need thereof. In another embodiment, the invention provides a method of treating ulcerative colitis, by administering a therapeutically effective amount of the Biogen TNFSF12 (TWEAK) antibody comprising at least one MRD to a patient in need thereof. In a further embodiment, the invention provides a method of treating psoriatic arthritis, ankylosing spondylitis, psoriasis, or juvenile idiopathic arthritis by administering a therapeutically effective amount of the Biogen TNFSF12 (TWEAK) antibody comprising at least one MRD to a patient in need thereof.

In an additional embodiment, the invention provides a method of treating a disorder of the immune system comprising administering a therapeutically effective amount of a CD25-binding MRD-containing antibody to a patient in need thereof. In a specific embodiment, the invention provides a method of treating a disorder of the immune system comprising administering a therapeutically effective amount of daclizumab comprising at least one MRD to a patient in need thereof. In one embodiment, the invention provides a method of treating an autoimmune disease by administering a therapeutically effective amount of daclizumab comprising at least one MRD to a patient in need thereof. In another embodiment, the invention provides a method of treating rheumatoid arthritis, by administering a therapeutically effective amount of daclizumab comprising at least one MRD to a patient in need thereof. In a further embodiment, the invention provides a method of treating systemic lupus erythematous comprising administering a therapeutically effective amount of a daclizumab-MRD-containing antibody to a patient in need thereof. In another embodiment, the invention provides a method of treating multiple sclerosis comprising administering a therapeutically effective amount of a daclizumab-MRD-containing antibody to a patient in need thereof. In one embodiment, the invention provides a method of treating an inflammatory disorder, by administering a therapeutically effective amount of daclizumab comprising at least one MRD to a patient in need thereof. In another embodiment, the invention provides a method of treating Crohn's disease, by administering a therapeutically effective amount of daclizumab comprising at least one MRD to a patient in need thereof. In a further embodiment, the invention provides a method of treating ulcerative colitis, by administering a therapeutically effective amount of daclizumab comprising at least one MRD to a patient in need thereof. In an additional embodiment, the invention provides a method of treating psoriatic arthritis, ankylosing spondylitis, psoriasis, or juvenile idiopathic arthritis by administering a therapeutically effective amount of daclizumab comprising at least one MRD to a patient in need thereof.

Antibody-MRD fusion proteins having antibodies and/or MRDs that bind cancer antigens or other targets associated with cancer establishment, progression, and/or metastasis are described herein or otherwise known in the art and may be used according to the methods of the invention to treat cancer. In specific embodiments the antibody-MRD fusion proteins comprise an antibody and/or MRD that bind to a target identified herein.

In another embodiment, the invention provides a method of treating cancer comprising administering a therapeutically effective amount of an EGFR-binding MRD-containing antibody to a patient in need thereof. In a specific embodiment, the invention provides a method of treating cancer comprising administering a therapeutically effective amount of cetuximab comprising at least one MRD to a patient in need thereof. In one embodiment, the invention provides a method of treating cancer by administering a therapeutically effective amount of cetuximab comprising at least one MRD to a patient having colorectal cancer. In another embodiment, therapeutic effective amounts of cetuximab comprising at least one MRD are administered to a patient to treat metastatic colorectal cancer, metastatic breast cancer, metastatic pancreatic cancer, or metastatic non-small cell lung carcinoma. In one embodiment, the invention provides a method of treating cancer by administering a therapeutically effective amount of cetuximab comprising at least one MRD to a patient having squamous cell carcinoma of the head and neck.

In another embodiment, a therapeutically effective amount of an EGFR-binding MRD-containing antibody is administered in combination with irinotecan, FOLFIRI, platinum-based chemotherapy, or radiation therapy. In a specific embodiment, a therapeutically effective amount of cetuximab comprising at least one MRD is administered in combination with irinotecan, FOLFIRI, platinum-based chemotherapy, or radiation therapy.

In certain embodiments, the invention provides a method of treating cancer comprising administering a therapeutically effective amount of an MRD-antibody described herein to a patient in need thereof.

In one embodiment, the invention provides a method of treating a solid cancer by administering a therapeutically effective amount of a solid cancer binding MRD-antibody described herein (e.g., an MRD-antibody that binds a validated solid tumor associated target as described herein to a patient in need thereof.

In some embodiments, the invention provides a method of treating a solid cancer by administering a therapeutically effective amount of an MRD-antibody that binds to a member selected from the group consisting of: IGFR1, ALK1, p-cadherin, CRYPTO, and alpha5 b1 integrin. In other embodiments, the antibody component of the administered MRD-antibody is a member selected from: figitumumab, CP-870893, PF-3,732,010, PF-3,446,962, volociximab, BIIB022, and the Biogen CRYPTO antibody.

In some embodiments, the multivalent and multispecific compositions (e.g., MRD-containing antibodies) described herein are useful for treating cancer. Thus, in some embodiments, the invention provides methods of treating cancer comprise administering a therapeutically effective amount of a MRD-containing antibody to a patient (e.g., a patient (subject) in need of treatment). In certain embodiments, the cancer is a cancer selected from the group consisting of colorectal cancer, pancreatic cancer, lung cancer, ovarian cancer, liver cancer, breast cancer, brain cancer, kidney cancer, prostate cancer, gastrointestinal cancer, melanoma, cervical cancer, bladder cancer, glioblastoma, and head and neck cancer. In certain embodiments, the cancer is breast cancer. In certain embodiments, the patient is a human.

Other examples of cancers or malignancies that may be treated with MRD containing antibodies and MRDs include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extra cranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extra cranial Germ Cell Tumor, Extra gonadal Germ Cell Tumor, Extra hepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo-/Malignant Fibrous Sarcoma, Osteosarcoma/Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, and Wilms' Tumor.

In some embodiments, multivalent and multispecific compositions (e.g., MRD-containing antibodies) are useful for inhibiting tumor growth. In certain embodiments, the method of inhibiting the tumor growth comprises contacting the cell with a MRD-containing antibody in vitro. For example, an immortalized cell line or a cancer cell line that expresses an MRD target and/or an antibody target is cultured in medium to which is added the MRD-containing antibody to inhibit tumor growth. In some embodiments, tumor cells are isolated from a patient sample for example, a tissue biopsy, pleural effusion, or blood sample and cultured in medium to which is added a MRD-containing antibody to inhibit tumor growth.

In some embodiments, the method of inhibiting tumor growth comprises contacting the tumor or tumor cells with a therapeutically effective amount of the MRD-containing antibody in vivo. In certain embodiments, contacting a tumor or tumor cell is undertaken in an animal model. For example, multivalent and multispecific compositions (e.g., MRD-containing antibodies) can be administered to xenografts in immunocompromised mice (e.g., NOD/SCID mice) to inhibit tumor growth. In some embodiments, cancer stem cells are isolated from a patient sample for example, a tissue biopsy, pleural effusion, or blood sample and injected into immunocompromised mice that are then administered a MRD-containing antibody to inhibit tumor cell growth. In some embodiments, the MRD-containing antibody is administered at the same time or shortly after introduction of tumorigenic cells into the animal to prevent tumor growth. In some embodiments, the MRD-containing antibody is administered as a therapeutic after the tumorigenic cells have grown to a specified size.

In certain embodiments, the method of inhibiting tumor growth comprises administering to a patient (subject) a therapeutically effective amount of a MRD-containing antibody. In certain embodiments, the patient is a human. In certain embodiments, the patient has a tumor or has had a tumor removed. In certain embodiments, the tumor expresses an antibody target. In certain embodiments, the tumor overexpresses the MRD target and/or the antibody target.

In certain embodiments, the inhibited tumor growth is selected from the group consisting of brain tumor, colorectal tumor, pancreatic tumor, lung tumor, ovarian tumor, liver tumor, breast tumor, kidney tumor, prostate tumor, gastrointestinal tumor, melanoma, cervical tumor, bladder tumor, glioblastoma, and head and neck tumor. In certain embodiments, the tumor is a breast tumor.

In additional embodiments, multivalent and multispecific compositions (e.g., MRD-containing antibodies) are useful for reducing tumorigenicity. Thus, in some embodiments, the method of reducing the tumorigenicity of a tumor in a patient, comprises administering a therapeutically effective amount of a multivalent and monovalent multispecific composition (e.g., MRD-containing antibody) to the patient. In certain embodiments, the tumor comprises cancer stem cells. In certain embodiments, the frequency of cancer stem cells in the tumor is reduced by administration of the multivalent and monovalent multispecific composition (e.g., MRD-containing antibody).

In other embodiments, multivalent and multispecific compositions (e.g., MRD-containing antibodies) are useful for diagnosing, treating or preventing a disorder of the immune system. In one embodiment, the disorder of the immune system is inflammation or an inflammatory disorder. In a more specific embodiment, the inflammatory disorder is selected from the group consisting of asthma, allergic disorders, and rheumatoid arthritis. In further embodiment, the disorder of the immune system is an autoimmune disease. Autoimmune disorders, diseases, or conditions that may be diagnosed, treated or prevented using multivalent and multispecific compositions (e.g., MRD-containing antibodies) include, but are not limited to, autoimmune hemolytic anemia, autoimmune neonatal thrombocytopenia, idiopathic thrombocytopenia purpura, autoimmune neutropenia, autoimmunocytopenia, hemolytic anemia, antiphospholipid syndrome, dermatitis, gluten-sensitive enteropathy, allergic encephalomyelitis, myocarditis, relapsing polychondritis, rheumatic heart disease, glomerulonephritis (e.g., IgA nephropathy), multiple sclerosis, neuritis, uveitis ophthalmia, polyendocrinopathies, purpura (e.g., Henloch-scoenlein purpura), Reiter's Disease, Stiff-Man Syndrome, autoimmune pulmonary inflammation, myocarditis, IgA glomerulonephritis, dense deposit disease, rheumatic heart disease, Guillain-Barre Syndrome, insulin dependent diabetes mellitus, and autoimmune inflammatory eye, autoimmune thyroiditis, hypothyroidism (i.e., Hashimoto's thyroiditis, systemic lupus erythematous, discoid lupus, Goodpasture's syndrome, Pemphigus, Receptor autoimmunities for example, (a) Graves' Disease, (b) Myasthenia Gravis, and (c) insulin resistance, autoimmune hemolytic anemia, autoimmune thrombocytopenic purpura, rheumatoid arthritis, scleroderma with anti-collagen antibodies, mixed connective tissue disease, polymyositis/dermatomyositis, pernicious anemia, idiopathic Addison's disease, infertility, glomerulonephritis such as, primary glomerulonephritis and IgA nephropathy, bullous pemphigoid, Sjogren's syndrome, diabetes mellitus, and adrenergic drug resistance (including adrenergic drug resistance with asthma or cystic fibrosis), chronic active hepatitis, primary biliary cirrhosis, other endocrine gland failure, vitiligo, vasculitis, post-MI, cardiotomy syndrome, urticaria, atopic dermatitis, asthma, inflammatory myopathies, and other inflammatory, granulomatous, degenerative, and atrophic disorders.

In another embodiment the disorder of the immune system diagnosed, treated or prevented using multivalent and multispecific compositions (e.g., MRD-containing antibodies) is selected from the group consisting of: Crohn's disease, Systemic lupus erythematous (SLE), inflammatory bowel disease, psoriasis, diabetes, ulcerative colitis, multiple sclerosis, and rheumatoid arthritis. In a preferred embodiment, the autoimmune disease is rheumatoid arthritis.

In other embodiments, a therapeutically effective amount of a multivalent and monovalent multispecific composition (e.g., MRD-containing antibody) is administered to a patient to treat a metabolic disease or disorder.

In other embodiments, a therapeutically effective amount of a multivalent and monovalent multispecific composition (e.g., MRD-containing antibody) is administered to a patient to treat a cardiovascular disease or disorder. In one embodiment, the multivalent and multispecific compositions (e.g., MRD-containing antibodies) is administered to a patient to treat thrombosis, atherosclerosis, heart attack, or stroke.

In another embodiments, a therapeutically effective amount of a multivalent and monovalent multispecific composition (e.g., MRD-containing antibodies) is administered to a patient to treat a musculoskeletal disease or disorder.

In further embodiments, a therapeutically effective amount of a multivalent and monovalent multispecific composition (e.g., MRD-containing antibody) is administered to a patient to treat a skeletal disease or disorder. In one embodiment, the multivalent and monovalent multispecific composition (e.g., MRD-containing antibody) is administered to a patient to treat osteoporosis.

In additional embodiments, the multivalent and monovalent multispecific composition binds (1) a target on a cell or tissue of interest (e.g., a tumor antigen on a tumor cell) and (2) a target on a leukocyte, such as, a T-cell receptor molecule. According to one embodiment, the binding of one or more targets by the multivalent and monovalent multispecific composition is used to direct an immune response to an infectious agent, cell, tissue, or other location of interest in a patient. For example, in some embodiments an MRD of the multivalent and monovalent multispecific composition binds a target on the surface of an effector cell. Thus, in some embodiments, an MRD of the multivalent and monovalent multispecific composition binds a target on the surface of a T cell. In specific embodiments an MRD of the multivalent and monovalent multispecific composition binds CD3. In other embodiments, an MRD of the multivalent and monovalent multispecific composition binds CD2. In further embodiments, an MRD of the multivalent and monovalent multispecific composition binds the T-cell receptor (TCR). According to additional embodiments, an MRD of the multivalent and monovalent multispecific composition binds a target on the surface of a Natural Killer Cell. Thus, in some embodiments, an MRD of the multivalent and monovalent multispecific composition binds a NKG2D (Natural Killer Group 2D) receptor. In additional embodiments an MRD of the multivalent and monovalent multispecific composition binds CD16 (i.e., Fc gamma RIII) CD64 (i.e., Fc gamma RI), or CD32 (i.e., Fc gamma RII). In additional embodiments, the multispecific composition contains more than one monospecific binding site for different targets.

Thus, in some embodiments, a multivalent and monovalent multispecific composition (e.g., an MRD-containing antibody) binds a target on a leukocyte and a tumor antigen on a tumor cell. In some embodiments, the MRD-containing antibody binds NKG2D. In further embodiments, an MRD-containing antibody binds NKG2D and a target selected from ErbB2, EGFR, IGF1R, CD19, CD20, CD80 and EPCAM. In some embodiments, the MRD-containing antibody binds CD3. In particular embodiments, the MRD-containing antibody binds CD3 epsilon. In further embodiments, an MRD-containing antibody binds CD3 and a target selected from ErbB2, EGFR, IGF1R, CD19, CD20, CD80 and EPCAM. In some embodiments, the MRD-containing antibody binds CD4. In further embodiments, an MRD-containing antibody binds CD4 and a target selected from ErbB2, EGFR, IGF1R, CD19, CD20, CD80 and EPCAM.

In further embodiments, the multivalent and monovalent multispecific composition has a single binding site (i.e., is monospecific) for a target. In some embodiments, the multivalent and monovalent multispecific composition has a single binding site (i.e., is monospecific) for a target on a leukocyte, such as, a T-cell (e.g., CD3) and binds a target on a cell or tissue of interest (e.g., a tumor antigen on a tumor cell, such as, a target disclosed herein).

In further embodiments, the invention is directed to treating a disease or disorder by administering a therapeutically effective amount of a multivalent and monovalent multispecific composition that has a single binding site (i.e., is monospecific) for a target. In some embodiments, the administered multivalent and monovalent multispecific composition has a single binding site (i.e., is monospecific) for a target on a leukocyte, such as, a T-cell (e.g., CD3) and binds a target on a cell or tissue of interest (e.g., a tumor associated antigen on a tumor cell). In some embodiments, the tumor cell is from a cancer selected from breast cancer, colorectal cancer, endometrial cancer, kidney (renal cell) cancer, lung cancer, melanoma, Non-Hodgkin Lymphoma, leukemia, prostate cancer, bladder cancer, pancreatic cancer, and thyroid cancer.

Additional embodiments are directed to administering a therapeutically effective amount of a multivalent and monovalent multispecific composition to treat a neurological disease or disorder selected from brain cancer, a neurodegenerative disease, schizophrenia, epilepsy, Alzheimer's disease, Parkinson's disease, Huntington's disease, ALS, multiple sclerosis, Neuromyelitis optica and Neuro-AIDS (e.g., HIV-associated dementia). In another embodiment, the multivalent and monovalent multispecific composition is administered to a patient to treat a brain cancer, metastatic cancer of the brain, or primary cancer of the brain. In a further embodiment, the multivalent and monovalent multispecific composition is administered to a patient to treat brain injury, stroke, spinal cord injury, or pain management. In further embodiments, the multivalent and monovalent multispecific composition is administered to a patient to treat brain injury, stroke, or spinal cord injury, or for pain management.

In one embodiment, a therapeutically effect amount of the multivalent and monovalent multispecific composition is administered to a patient to treat an infection or a symptom associated with an infection caused by an infectious agent. In some embodiments, the infection is caused by a member selected from apovavirus (e.g., JC polyomavirus), trypanosomes, West Nile virus, HIV, *Streptococcus pneumoniae* and *Haemophilus influenzae*, bovine spongiform encephalopathy, meningitis, Progressive multifocal leukoencephalopathy (PML), Late-stage neurological trypanosomiasis, Encephalitis, and rabies.

According to some embodiments, the multivalent and monovalent multispecific composition (e.g., MRD-containing antibody) is able to cross the blood brain barrier (BBB) and bind a target located on the brain side of the BBB. In additional embodiments, the multivalent and monovalent multispecific composition has a single binding site that binds a target (e.g., ligand, receptor, or accessory protein) associated with an endogenous BBB receptor mediated transport system. In some embodiments, a single binding site of the composition is an MRD. In other embodiments, a single binding site of the composition is an antibody antigen binding domain. In some embodiments, the multivalent and monovalent multispecific composition contains 1, 2, 3, 4, 5, or more single binding sites (i.e., monovalently binds) for a target associated with an endogenous BBB receptor mediated transport system and the composition is able to cross to the cerebrospinal fluid side of the BBB. In additional embodiments, the multivalent and monovalent multispecific composition contains 1, 2, 3, 4, 5, or more multiple binding sites (i.e., multivalently binds) for a target associated with an endogenous BBB receptor mediated transport system and the composition is able to cross to the cerebrospinal fluid side of the BBB. In additional embodiments, a therapeutically effective amount of an MRD-containing antibody is administered to a patient to treat a neurological disease or disorder selected from brain cancer, a neurodegenerative disease, schizophrenia, epilepsy, Alzheimer's disease, Parkinson's disease, Huntington's disease, ALS, multiple sclerosis, neuromyelitis optica and beuro-AIDS (e.g., HIV-associated dementia). In some embodiments, the multivalent and monovalent multispecific composition has a single binding site (i.e., is monovalent for binding a particular target (antigen)) or two or more binding sites (i.e., is monovalent for binding a particular target) for a target selected from alpha-synuclein, RGM A, NOGO A, NgR, OMGp MAG, CSPG, neurite inhibiting semaphorins (e.g., Semaphorin 3A and Semaphorin 4) an ephrin, A-beta, AGE (S100 A, amphoterin), NGF, soluble A-B, aggrecan, midkine, neurocan, versican, phosphacan, Te38 and PGE2. In some embodiments, the multivalent and monovalent multispecific composition additionally has a single binding site or multiple binding sites for a target selected from IL1, IL1R, IL6, IL6R, IL12, IL18, IL23, TNFSF12 (TWEAK), TNFRSF5 (CD40), TNFSF5 (CD40 LIGAND), CD45RB, CD52, CD200, VEGF, VLA4, TNF alpha, Interferon gamma, GMCSF, FGF, C5, CXCL13, CCR2, CB2, MIP 1a, and MCP-1.

In additional embodiments, the multivalent and monovalent multispecific composition is capable of transferring to the cerebrospinal fluid side of the BBB and is administered to a patient to treat a neurological disease or disorder selected from: brain cancer, a neurodegenerative disease, schizophrenia, epilepsy, Alzheimer's disease, Parkinson's disease, Huntington's disease, ALS, multiple sclerosis, neuromyelitis optica and neuro-AIDS (e.g., HIV-associated dementia). In further embodiments, the invention is directed to treating a disease or disorder by administering an MRD-containing antibody that has a single binding site (i.e., is monospecific) for a target to a patient in need thereof. In some embodiments, the administered MRD-containing antibody has a single binding site (i.e., is monospecific) for a target on a leukocyte, such as, a T-cell (e.g., CD3) and binds a target on a cell or tissue of interest (e.g., a tumor associated antigen on a tumor cell).

In some embodiments, the multivalent and monovalent multispecific composition is administered to a patient to treat a neurological disease or disorder selected from brain cancer, a neurodegenerative disease, schizophrenia, epilepsy, Alzheimer's disease, Parkinson's disease, Huntington's disease, ALS, multiple sclerosis, Neuromyelitis optica and Neuro-AIDS (e.g., HIV-associated dementia). In additional embodiments, the multivalent and monovalent multispecific composition is administered to a patient to treat a brain cancer, metastatic cancer of the brain, or primary cancer of the brain. In additional embodiments, the multivalent and monovalent multispecific composition is administered to a patient to treat brain injury, stroke, spinal cord injury, or pain. Thus, according to some embodiments, the disease, disorder, or injury treated or prevented with an MRD-containing antibody or MRD of the invention is neurological. In one embodiment, the neurological disease, disorder or injury is associated with pain such as, acute pain or chronic pain.

In some embodiments the multivalent and monovalent multispecific composition binds at least 1, 2, 3, 4, or 5 targets associated with a neurological disease or disorder. In one embodiment, the multivalent and monovalent multispecific composition (e.g., MRD-containing antibody) binds 1, 2, or all 3 of the targets RGM A; NgR, and NogoA. In another embodiment, the multivalent and monovalent multispecific composition binds 1, 2, 3, or all 4 of RGM A, RGM B, and Semaphorin 3A or Semaphorin 4. In a further embodiment, the multivalent and monovalent multispecific composition binds at least 1, 2, 3, 4 or 5 targets selected from aggrecan, midkine, neurocan, versican, phosphacan, Te38, TNF alpha, NogoA, RGM A, MAG, and OMGp. In another embodiment, the multivalent and monovalent multispecific composition binds at least 1, 2, 3, 4 or 5 targets selected from aggrecan, midkine, neurocan, versican, phosphacan, Te38 and TNF alpha. In an alternative embodiment, the multivalent and monovalent multispecific composition binds at least 1, 2, 3, 4 or 5 targets selected from NgR-p75, NgR-Troy, NgR-Nogo66 (Nogo), NgR-Lingo, Lingo-Troy, Lingo-p75, MAG and Omgp. In another embodiment, the multivalent and monovalent multispecific composition binds at least 1, 2, 3, 4 or 5 targets selected from NGF, prostaglandin E2 (PGE2), TNF-alpha, IL1 beta, and IL6R.

In an additional embodiment, the multivalent and monovalent multispecific composition binds at least 1, 2, 3, 4 or 5 targets selected from alpha-synuclein, RGM A and one or more pro-inflammatory mediators (e.g., TNF alpha, IL1, and MCP-1). Such compositions have applications in, for example, treating neurodegenerative diseases such as, Parkinson's.

In another embodiment, the multivalent and monovalent multispecific composition binds and antagonizes (i.e., is an antagonist of e.g., inhibits the activity of) 1, 2, 3, 4 or 5 targets selected from RGM A, NOGO A, neurite inhibiting semaphorins (e.g., Semaphorin 3A and Semaphorin 4), ephrins and pro-inflammatory targets (e.g., IL12, TNFSF12 (TWEAK), IL23, CXCL13, TNFRSF5 (CD40), TNFSF5 (CD40 LIGAND), IL18, VEGF, VLA4, TNF alpha, CD45RB, CD200, interferon gamma, GMCSF, FGF, C5, CD52, and CCR2). In an additional embodiment, the multivalent and monovalent multispecific composition binds and antagonizes 1, 2, 3, 4 or 5 targets selected from CD3, IL2, IL2R, IL6, IL6R, IL10, IL12p40, IL23, TGF beta, TNFRSF21 (DR6), fn14, CD20, LINGO, CXCL13 and CCL2. The compositions have applications in treating for example, inflammation, neuroregeneration and neurodegenerative disorders, such as MS). Multivalent and multispecific compositions (e.g., MRD-containing antibodies) that bind at least 1, 2, 3, 4, 5 or more of these targets are also encompassed by the invention. In specific embodiments, the antibody component of the MRD-containing antibody binds CD3, CD20, CD52, VLA4, TNF, TNFRSF21 (DR6), LINGO, CD3, interferon gamma or IL6.

In another embodiment, the multivalent and monovalent multispecific composition binds and antagonizes (i.e., is an antagonist of) 1, 2, 3, 4 or 5 targets selected from AGE (S100 A, amphoterin), pro-inflammatory cytokines (e.g., IL1, IL6, and TNF), chemokines (e.g., MCP 1), and molecules that inhibit neural regeneration (e.g., Nogo and RGM A). These compositions have applications in treating, for example, chronic neurodegenerative diseases such as, Alzheimer's. In an additional embodiment, the composition of the invention binds at least 1, 2, 3, 4 or 5 targets that influence neural generation and survival including, for example, NGF agonists, IL1 or IL1R antagonists, and A-beta. These compositions have applications in treating, for example, chronic neurodegenerative diseases such as, Alzheimer's.

In an additional embodiment, the composition of the invention binds to and antagonizes 1, 2, 3, 4, or 5 targets that targets that interfere with neural regeneration or recovery, including NogoA, OMgp MAG, RGM A, CSPG, one or more astrocyte inhibiting semaphorins (e.g., Semaphorin 3A and Semaphorin 4), ephrins, and pro-inflammatory cytokines (e.g., IL1, IL6, and TNF). These compositions have applications in treating neurodegenerative diseases and neural injury or trauma.

In additional embodiment, the multivalent and monovalent multispecific composition binds and antagonize (i.e., is an antagonist of) 1, 2, 3, 4, or 5 targets associated with pain, including, but not limited to, NGF and SCN9A/NAV1.7. Such compositions have applications in for example, treating or alleviating pain and pain associated conditions.

In additional embodiments, the targets bound by the compositions of the invention binds and antagonizes 1, 2, 3, 4, 5 or more mediators and or soluble or cell surface targets implicated in the inhibition of neurite growth or recovery. In specific embodiments, compositions of the invention bind to and antagonizes 1, 2, 3, 4, 5 or more targets selected from Nogo, Ompg, MAG, RGM A, semaphorins, ephrins, soluble A-b, pro-inflammatory cytokines (e.g., IL1 and TNF alpha), chemokines (e.g., MIP 1a).

In some embodiments, the invention provides a method of treating or ameliorating pain by administering a therapeutically effective amount of a pain target binding MRD-antibody, to a patient in need thereof. In additional embodiments, the invention provides a method of treating or ameliorating pain by administering a therapeutically effective amount of an NGF binding MRD-antibody, to a patient in need thereof. In further embodiments, the invention provides a method of treating or ameliorating pain by administering a therapeutically effective amount of tanezumumab (e.g., Pfizer) comprising an MRD, to a patient in need thereof.

In additional embodiments, the invention provides a method of treating or ameliorating Alzheimer's by administering a therapeutically effective amount of an Alzheimer's target binding MRD-antibody, to a patient in need thereof. In additional embodiments, the invention provides a method of treating or ameliorating Alzheimer's by administering a therapeutically effective amount of a beta amyloid binding MRD-antibody, to a patient in need thereof. In additional embodiments, the invention provides a method of treating or ameliorating Alzheimer's by administering a therapeutically effective amount of RN1219 (PF-4,360,365; Pfizer) comprising an MRD, to a patient in need thereof.

In additional embodiments, the invention provides a method of treating or ameliorating multiple sclerosis by administering a therapeutically effective amount of a multiple sclerosis target binding MRD-antibody, to a patient in need thereof. In additional embodiments, the invention provides a method of treating or ameliorating multiple sclerosis by administering a therapeutically effective amount of a LINGO binding MRD-antibody, to a patient in need thereof. In another embodiment, the invention provides a method of treating or ameliorating multiple sclerosis by administering a therapeutically effective amount of an MRD-antibody that binds LINGO and TNFRSF21 (DR6) to a patient in need thereof. In additional embodiments, the invention provides a method of treating or ameliorating multiple sclerosis by administering a therapeutically effective amount of the Biogen LINGO antibody comprising an MRD, to a patient in need thereof. In further embodiments, the invention provides a method of treating or ameliorating multiple sclerosis by administering a therapeutically effective amount of the natalizumab (e.g., TYSABRI®; Biogen) comprising an MRD, to a patient in need thereof. In an additional embodiment, the invention provides a method of treating or ameliorating multiple sclerosis by administering a therapeutically effective amount of the Biogen LINGO antibody comprising an MRD, to a patient in need thereof.

In an additional embodiment, the invention provides a method of treating or ameliorating multiple sclerosis by administering a therapeutically effective amount of a CD20 binding MRD-antibody, to a patient in need thereof. In one embodiment, the invention provides a method of treating or ameliorating multiple sclerosis by administering a therapeutically effective amount of the ocrelizumab (Biogen Idec) comprising an MRD, to a patient in need thereof.

In other embodiments, the multivalent and multispecific compositions (e.g., MRD-containing antibodies) are useful for treating or preventing an infectious disease. Infectious diseases that may be treated or prevented with multivalent and multispecific compositions (e.g., MRD-containing antibodies) include, but are not limited to, diseases associated with yeast, fungal, viral and bacterial infections. Viruses causing viral infections which can be treated or prevented with multivalent and multispecific compositions (e.g., MRD-containing antibodies) include, but are not limited to, retroviruses (e.g., human T-cell lymphotrophic virus (HTLV) types I and II and human immunodeficiency virus (HIV)), herpes viruses (e.g., herpes simplex virus (HSV) types I and II, Epstein-Barr virus, HHV6-HHV8, and cytomegalovirus), adenoviruses (e.g., lassa fever virus), paramyxoviruses (e.g., morbilivirus virus, human respiratory syncytial virus, mumps, and pneumovirus), adrenoviruses, bunyaviruses (e.g., hantavirus), cornaviruses, filoviruses (e.g., Ebola virus), flaviviruses (e.g., hepatitis C virus (HCV), yellow fever virus, and Japanese encephalitis virus), hepadnaviruses (e.g., hepatitis B viruses (HBV)), orthomyoviruscs (e.g., influenza viruses A, B and C (including avian influenza, e.g., H5N1 subtype)), papovaviruses (e.g., papillomaviruses), picomaviruses (e.g., rhinoviruses, enteroviruses and hepatitis A viruses), poxviruses, reoviruses (e.g., rotaviruses), togaviruses (e.g., rubella virus), rhabdoviruses (e.g., rabies virus). Microbial pathogens causing bacterial infections include, but are not limited to, *Streptococcus pyogenes, Streptococcus pneumoniae, Neisseria gonorrhoea, Neissetia meningitidis, Corynebacterium diphtheriae, Clostridium botulinum, Clostridium pefringens, Clostridium tetani, Haemophilus influenzae, Klebsiella pneumoniae, Klebsiella ozaenae, Klebsiella rhinoscleromotis, Staphylococcus aureus, Vibrio cholerae, Escherichia coli, Pseudomonas aeruginosa, Campylobacter (Vibrio) fetus, Campylobacter jejuni, Aeromonas hydrophila, Bacillus cereus, Edwardsiella tarda, Yersinia enterocolitica, Yersinia pestis, Yersinia pseudotuberculosis, Shigella dysenteriae, Shigellaflexneri, Shigella sonnei, Salmonella typhimurium, Treponema pallidum, Treponema pertenue, Treponema carateneum, Borrelia vincentii, Borrelia burgdorferi, Leptospira icterohemorrhagiae, Mycobacterium tuberculosis, Toxoplasma gondii, Pneumocystis carinii, Francisella tularensis, Brucella abortus, Brucella suis, Brucella melitensis, Mycoplasma* spp., *Rickettsia prowazeki, Rickettsia Lsutsugumushi, Chlamydia* spp., and *Helicobacter pylori.*

In a preferred embodiment, the he multivalent and multispecific compositions (e.g., MRD-containing antibodies) are administered to a patient to treat or prevent human immunodeficiency virus (HIV) infection or AIDS, botulism, anthrax, or *clostridium difficile.*

VIII MRD Linked Compounds that are not Antibodies

In a distinct group of embodiments, one or more MRDs of the invention are operably linked to the amino and/or carboxy terminus of an immunoglobulin fragment, such as Fab, Fab', F(ab')2, pFc', or Fc. In some embodiments, the MRDs are operably linked to a Fab or Fc polypeptide containing an additional Ig domain. In some embodiments, the MRDs are operably linked to the amino and/or carboxy terminus of an immunoglobulin fragment that is also operably linked to an scFv. In other embodiments, the MRDs of the invention are operably linked to an Fc-fusion protein.

According to this group of embodiments, one two, three, four, five, six, seven to ten, or more than ten MRDs are operably linked to the amino terminus and/or carboxy terminus of the immunoglobulin fragment. These MRDs are optionally linked to one another or to the immunoglobulin fragment via a linker. In one embodiment, one, two, three, four, five, six, seven to ten, or more than ten, of the MRDs operably linked to the amino terminus and/or carboxy terminus of the immunoglobulin fragment are the same. In another embodiment, one, two, three, four, five, six, seven to ten, or more than ten, of the MRDs operably linked to the amino terminus and/or carboxy terminus of the immunoglobulin fragment are different.

The MRDs operably linked to the immunoglobulin fragment can be monomeric (i.e., containing one MRD at the terminus of a peptide chain optionally connected by a linker) or multimeric (i.e., containing more than one MRD in tandem optionally connected by a linker). The MRDs can be homo-multimeric (i.e., containing more than one of the same MRD in tandem optionally connected by linker(s) (e.g., homodimers, homotrimers, homotetramers etc.)) or heteromultimeric (i.e., containing two or more MRDs in which there are at least two different MRDs optionally connected by linker(s) where all or some of the MRDs linked to a particular terminus are different (e.g., heterodimer)). In one embodiment, two different monomeric MRDs are located at different termini of the immunoglobulin fragment. In another embodiment, three, four, five, six, or more different monomeric MRDs are located at different termini of the immunoglobulin fragment.

In an alternative embodiment, the MRD-containing antibody contains at least one dimeric and one monomeric MRD located at different immunoglobulin termini. In another alternative embodiment, the MRD-containing antibody contains at least one homodimeric and one monomeric MRD located at different immunoglobulin termini. In another alternative embodiment, the MRD-containing antibody contains at least one heterodimeric and one monomeric MRD located at different immunoglobulin termini.

In an alternative embodiment, the MRD-containing antibody contains at least one multimeric and one monomeric MRD located at different immunoglobulin termini. In another alternative embodiment, the MRD-containing antibody contains at least one homomultimeric and one monomeric MRD located at different immunoglobulin termini. In another alternative embodiment, the MRD-containing antibody contains at least one heteromultimeric and one monomeric MRD located at different immunoglobulin termini.

Multiple MRDs that are operably linked to the immunoglobulin fragment can target the same target binding site, or two or more different target binding sites. Where the MRDs bind to different target binding sites, the binding sites may be on the same or different targets. Similarly, one or more of the MRDs may bind to the same target as the immunoglobulin fragment.

In some embodiments, at least one of the MRDs and if applicable, the immunoglobulin fragment (e.g., where the immunoglobulin fragment is an Fab), bind to their targets simultaneously. In additional embodiments, two, three, four, five, six, seven, eight, nine, ten, or more than ten MRDs, and if applicable the immunoglobulin fragment, bind to their targets simultaneously.

The synthesis of MRDs operably linked to an immunoglobulin fragment and the assay of these MRDs and immunoglobulin fragment for their ability to bind, or compete for binding with one or more targets simultaneously can be routinely accomplished using methods disclosed herein or otherwise known in the art.

In a specific embodiment, one or more of the operably linked MRDs or the immunoglobulin fragment, binds to VEGF. In another specific embodiment, one or more of the operably linked MRDs or the immunoglobulin fragment, binds to the same epitope as ranibizumab (LUCENTIS®, Genentech). In another specific embodiment, one or more of the operably linked MRDs or the immunoglobulin fragment, competitively inhibits ranibizumab binding to VEGF. In an additional embodiment, the immunoglobulin fragment is a Fab. In a further specific embodiment, the immunoglobulin fragment is ranibizumab.

In another embodiment, the invention provides a method of treating macular degeneration comprising administering a therapeutically effective amount of a VEGFA or VEGFR binding MRD-immunoglobulin fragment fusion to a patient in need thereof. In a specific embodiment, the invention provides a method of treating macular degeneration comprising administering a therapeutically effective amount of a VEGFA or VEGFR binding MRD-Fab fusion to a patient in need thereof. In a specific embodiment, the invention provides a method of treating macular degeneration comprising administering a therapeutically effective amount of MRD-ranibizumab to a patient in need thereof.

In other embodiments the one or more MRDs of the invention are operably linked to the amino and/or carboxyl terminus of an Fc fusion protein. The Fc fusion protein can contain fusions to any protein or polypeptide sequence of therapeutic value, for example, any of the targets or receptors of the targets described herein. For example, the fusions can contain the extracellular domain of receptors or ligands that typically function or display improved cognate-partner binding in multimeric form, including for example, receptors corresponding to the TNF-R superfamily (e.g., TNFR2, TACI, BCMA, HVEM, etc.), IL receptor superfamily (e.g., IL1-R-IL6R), VEGFR superfamily (e.g., VEGFR1-VEGR3), FGRFR superfamily (e.g., FGFR1-FGFR4), and B7 superfamily (e.g., CTLA)).

In a specific embodiment, one, two, three, four, five, six, or more MRDs are operably linked to a VEGR1/VEGFR2-Fc fusion protein. In another specific embodiment, one or more of the operably linked MRDs bind to the same epitope as aflibercept (Regeneron). In another specific embodiment, one or more of the operably linked MRDs competitively inhibit aflibercept binding to VEGFA or PLGF. In a further specific embodiment, the MRDs are operably linked to aflibercept.

In another embodiment, the invention provides a method of treating cancer comprising administering a therapeutically effective amount of an MRD-VEGFR1/VEGFR2-Fc fusion protein to a patient in need thereof. In a specific embodiment, the invention provides a method of treating colorectal cancer, prostate cancer, or non-small cell lung cancer comprising administering a therapeutically effective amount of a VEGFA or PLGF binding MRD-Fc fusion protein to a patient in need thereof. In a specific embodiment, the invention provides a method of treating macular degeneration comprising administering a therapeutically effective amount of a VEGFA or PLGF binding MRD-Fc fusion protein and irinotecan, 5FU, oxaliplatin, doxetaxel, or FOLFOX6, to a patient in need thereof.

In another embodiment, the invention provides a method of treating cancer comprising administering a therapeutically effective amount of MRD-aflibercept to a patient in need thereof. In a specific embodiment, the invention provides a method of treating colorectal cancer, prostate cancer, or non-small cell lung cancer comprising administering a therapeutically effective amount of MRD-aflibercept to a patient in need thereof. In a specific embodiment, the invention provides a method of treating macular degeneration comprising administering a therapeutically effective amount of MRD-aflibercept and irinotecan, 5FU, oxaliplatin, doxetaxel, or FOLFOX6, to a patient in need thereof.

In a specific embodiment, one, two, three, four, five, six, or more MRDs are operably linked to a CTLA4-Fc fusion protein. In another specific embodiment, one or more of the operably linked MRDs bind to the same epitope as abatacept (ORENCIA®). In another specific embodiment, one or more of the operably linked MRDs competitively inhibits abatacept binding to CD80 (B7-1) or CD86 (B7-2). In a further specific embodiment, the MRDs are operably linked to abatacept. In another specific embodiment, one or more of the operably linked MRDs bind to the same epitope as belatacept (Bristol Myers Squibb). In another specific embodiment, one or more of the operably linked MRDs competitively inhibits belatacept binding to CD80 (B7-1) or CD86 (B7-2). In an additional embodiment, the immunoglobulin fragment is a Fab. In a further specific embodiment, the MRDs are operably linked to belatacept.

In another embodiment, the invention provides a method of suppressing an immune response comprising administering a therapeutically effective amount of an MRD-CTLA4-Fc fusion protein to a patient in need thereof. In a specific embodiment, the invention provides a method suppressing an immune response comprising administering a therapeutically effective amount of MRD-abatacept to a patient in need thereof. In another specific embodiment, the invention provides a method of treating rheumatoid arthritis comprising administering a therapeutically effective amount of MRD-abatacept to a patient in need thereof. In another specific embodiment, the invention provides a method of suppressing an immune response to a graft rejection comprising administering a therapeutically effective amount of MRD-abatacept to a patient in need thereof.

In a specific embodiment, the invention provides a method of suppressing an immune response comprising administering a therapeutically effective amount of MRD-belatacept to a patient in need thereof. In another specific embodiment, the invention provides a method of suppressing an immune response to a graft rejection comprising administering a therapeutically effective amount of MRD-belatacept to a patient in need thereof.

In another specific embodiment, one, two, three, four, five, six, or more MRDs are operably linked to a TNFR2-Fc fusion protein. In another specific embodiment, one or more of the operably linked MRDs bind to the same epitope as etanercept (ENBREL®). In another specific embodiment, one or more of the operably linked MRDs competitively inhibits etanercept binding to TNF alpha. In another embodiment, one or more of the operably linked MRDs binds ANG2. In a further specific embodiment, the MRDs are operably linked to etanercept.

In another embodiment, the invention provides a method of suppressing an immune response comprising administering a therapeutically effective amount of a MRD-TNFR2-Fc fusion protein to a patient in need thereof. In one embodiment, the invention provides a method of treating an autoimmune disease by administering a therapeutically effective amount of a MRD-TNFR2-Fc fusion protein to a patient in need thereof. In one embodiment, the invention provides a method of treating rheumatoid arthritis, by administering a therapeutically effective amount of an MRD-TNFR2-Fc fusion protein to a patient in need thereof. In one embodiment, the invention provides a method of treating an inflammatory disorder, by administering a therapeutically effective amount of an MRD-TNFR2-Fc fusion protein to a patient in need thereof. In another embodiment, the invention provides a method of treating Crohn's disease, by administering a therapeutically effective amount of an MRD-TNFR2-Fc fusion protein to a patient in need thereof. In another embodiment, the invention provides a method of treating ulcerative colitis, by administering a therapeutically effective amount of an MRD-TNFR2-Fc fusion protein to a patient in need thereof. In another embodiment, the invention provides a method of treating psoriatic arthritis, ankylosing spondylitis, psoriasis, or juvenile idiopathic arthritis by administering a therapeutically effective amount of an MRD-TNFR2-Fc fusion protein to a patient in need thereof.

In another embodiment, the invention provides a method of suppressing an immune response comprising administering a therapeutically effective amount of a MRD-etanercept-Fc fusion protein to a patient in need thereof. In one embodiment, the invention provides a method of treating an autoimmune disease by administering a therapeutically effective amount of MRD-etanercept to a patient in need thereof. In one embodiment, the invention provides a method of treating rheumatoid arthritis, by administering a therapeutically effective amount of MRD-etanercept to a patient in need thereof. In one embodiment, the invention provides a method of treating an inflammatory disorder, by administering a therapeutically effective amount of MRD-etanercept to a patient in need thereof. In another embodiment, the invention provides a method of treating Crohn's disease, by administering a therapeutically effective amount of MRD-etanercept to a patient in need thereof. In another embodiment, the invention provides a method of treating ulcerative colitis, by administering a therapeutically effective amount of MRD-etanercept to a patient in need thereof. In another embodiment, the invention provides a method of treating psoriatic arthritis, ankylosing spondylitis, psoriasis, or juvenile idiopathic arthritis by administering a therapeutically effective amount of MRD-etanercept to a patient in need thereof.

In another specific embodiment, one, two, three, four, five, six, or more MRDs are operably linked to a TACI-Fc fusion protein. In another specific embodiment, one or more of the operably linked MRDs bind to the same epitope as atacicept (Merck/Serono). In another specific embodiment, one or more of the operably linked MRDs competitively inhibits atacicept binding to BLyS or APRIL. In a further specific embodiment, the MRDs are operably linked to atacicept.

In another embodiment, the invention provides a method of suppressing an immune response comprising administering a therapeutically effective amount of a MRD-TACI-Fc fusion protein to a patient in need thereof. In one embodiment, the invention provides a method of treating an autoimmune disease by administering a therapeutically effective amount of a MRD-TACI-Fc fusion protein to a patient in need thereof. In one embodiment, the invention provides a method of treating rheumatoid arthritis, by administering a therapeutically effective amount of a MRD-TACI-Fc fusion protein to a patient in need thereof. In one embodiment, the invention provides a method of treating systemic lupus erythematous by administering a therapeutically effective amount of a MRD-TACI-Fc fusion protein to a patient in need thereof. In another embodiment, the invention provides a method of suppressing an immune response comprising administering a therapeutically effective amount of an MRD-atacicept fusion protein to a patient in need thereof. In one embodiment, the invention provides a method of treating an autoimmune disease by administering a therapeutically effective amount of an MRD-atacicept fusion protein to a patient in need thereof. In one embodiment, the invention provides a method of treating rheumatoid arthritis, by administering a therapeutically effective amount of an MRD-atacicept protein fusion protein to a patient in need thereof. In one embodiment, the invention provides a method of treating systemic lupus erythematous, by administering a therapeutically effective amount of an MRD-atacicept fusion protein to a patient in need thereof.

In another specific embodiment, one, two, three, four, five, six, or more MRDs are operably linked to an IL1R-Fc fusion protein. In another specific embodiment, one or more of the operably linked MRDs bind to the same epitope as rilonacept (Regeneron). In another specific embodiment, one or more of the operably linked MRDs competitively inhibits rilonacept binding to IL1R. In a further specific embodiment, the MRDs are operably linked to rilonacept.

In another embodiment, the invention provides a method of preventing gout comprising administering a therapeutically effective amount of a MRD-IL1R-Fc fusion protein to a patient in need thereof. In a specific embodiment, the invention provides a method of preventing gout comprising administering a therapeutically effective amount of an MRD-rilonacept-Fc fusion protein to a patient in need thereof.

In some embodiments, the invention encompasses a complex comprising an antibody and at least one modular recognition domain (MRD), wherein the MRD comprises at least two cysteines, wherein a first cysteine is located within the first ten amino acids of the MRD, a second cysteine is located within the last ten amino acids of the MRD, and wherein the MRD comprises at least five amino acids between said first cysteine and said second cysteine. In additional embodiments, the MRD comprises at least 10, 15, 20, or 25 amino acids between the first cysteine and the second cysteine. In some embodiments, the MRD comprises at least one proline between the first cysteine and the second cysteine. In other embodiments, the MRD comprises at least two proline between the first cysteine and the second cysteine. In some embodiments, the first cysteine is no more than 5, 3, 3, 2, or 1 amino acids away from the N-terminus of the complex. In some embodiments, the second cysteine is no more than 5, 3, 3, 2, or 1 amino acids away from the C-terminus of the complex. In some embodiments, the in vivo half-life of an MRD in a complex of the invention is increased compared to the half-life of an MRD in a corresponding complex wherein at least one of the cysteines is mutated or deleted. In some embodiments, the binding affinity of the MRD is at least equal to the binding affinity of an MRD in a corresponding complex wherein at least one of the cysteines is mutated or deleted.

In some embodiments, the invention encompasses a complex comprising an antibody and at least one modular recognition domain (MRD), wherein the antibody and the MRD bind to different targets or epitopes on the same cell or molecule, wherein the MRD binding agonizes or antagonizes the MRD target under physiological conditions, and wherein said MRD does not bind to and agonize or antagonize said MRD target under physiological conditions in the absence of said antibody. In some embodiments, an MRD in the complex of the invention binds the MRD target in the absence of the antibody with an EC50 of greater than 0.01 nM, 0.1 nM, 0.5 nM, or 0.7 nM under physiological conditions.

In some embodiments, the invention encompasses a complex comprising an antibody and at least one MRD, wherein the antibody and the MRD bind to different targets or epitopes on a heteromeric or homomeric protein, wherein the MRD binding agonizes or antagonizes the MRD target under physiological conditions, and wherein said MRD does not bind to and agonize or antagonize said MRD target under physiological conditions in the absence of the antibody. In some embodiments, an MRD in the complex of the invention binds the MRD target with an EC50 of greater than 0.01 nM, 0.1 nM, 0.5 nM, or 0.7 nM under physiological conditions.

In some embodiments, the invention encompasses a method for inhibiting the growth of a cell comprising contacting the cell with a multispecific and multivalent complex comprising an antibody and at least one modular recognition domain (MRD), and a protein kinase inhibitor. In some embodiments, the antibody binds to a target selected from: VEGF, VEGFR1, EGFR, ErbB2, IGF-IR, cMET, FGFR1, and FGFR2. In some embodiments, the protein kinase inhibitor inhibits a target of the MRD containing antibody. In some embodiments, the protein kinase inhibitor inhibits a different target than the MRD containing antibody. In some embodiments, the protein kinase inhibitor inhibits more than one protein kinase. In some embodiments, the protein kinase inhibitor is a member selected from: imatinib, gefitinib, vandetanib, erlotinib, sunitinib, lapatinib, and sorafenib.

In some embodiments, the invention encompasses a method for inhibiting angiogenesis in a patient comprising administering to said patient a therapeutically effective amount of a multispecific and multivalent complex comprising an antibody and at least one modular recognition domain (MRD), and a protein kinase inhibitor. In some embodiments, the antibody binds to a target selected from: VEGF, VEGFR1, EGFR, ErbB2, IGF-IR, cMET, FGFR1, and FGFR2. In some embodiments, the protein kinase inhibitor inhibits a target of the MRD containing antibody. In some embodiments, the protein kinase inhibitor inhibits a different target than the MRD containing antibody. In some embodiments, the protein kinase inhibitor inhibits more than one protein kinase. In some embodiments, the protein kinase inhibitor is a member selected from: imatinib, gefitinib, vandetanib, erlotinib, sunitinib, lapatinib, and sorafenib.

In some embodiments, the invention encompasses a method for treating a patient having cancer comprising administering to said patient a therapeutically effective amount of a multispecific and multivalent complex comprising an antibody and at least one modular recognition domain (MRD), and a protein kinase inhibitor. In some embodiments, the antibody binds to a target selected from: VEGF, VEGFR1, EGFR, ErbB2, IGF-IR, cMET, FGFR1, and FGFR2. In some embodiments, the protein kinase inhibitor inhibits a target of the MRD containing antibody. In some embodiments, the protein kinase inhibitor inhibits a different target than the MRD containing antibody. In some embodiments, the protein kinase inhibitor inhibits more than one protein kinase. In some embodiments, the protein kinase inhibitor is a member selected from: imatinib, gefitinib, vandetanib, erlotinib, sunitinib, lapatinib, and sorafenib.

In some embodiments, the invention encompasses a method for treating a patient having a disease or disorder of the immune system comprising administering to said patient a therapeutically effective amount of a multispecific and multivalent complex comprising an antibody and at least one modular recognition domain (MRD), and a protein kinase inhibitor. In some embodiments, the disease or disorder of the immune system is inflammation or an autoimmune disease. In further embodiments, the autoimmune disease is rheumatoid arthritis, Crohn's disease, systemic lupus erythematous, inflammatory bowel disease, psoriasis, diabetes, ulcerative colitis, or multiple sclerosis. In additional embodiments, the antibody binds TNF. In some embodiments, the protein kinase inhibitor inhibits a target that is not a target of the MRD-containing antibody. In some embodiments, the protein kinase inhibitor inhibits more than one protein kinase. In further embodiments, the protein kinase inhibitor is a member selected from: lestaurtinib, tofacitinib, ruxolitinib, SB1518, CYT387, LY3009104, TG101348, fostamatinib, BAY 61-3606, and sunitinib.

In some embodiments, the invention encompasses a multivalent and multispecific complex comprising an antibody and at least one modular recognition domain (MRD), wherein the complex has a single binding site for a cell surface target. In some embodiments, the multivalent and multispecific complex comprises 2 single binding sites for different epitopes on the same target. In some embodiments, the multivalent and multispecific complex has 2, 3, 4, 5 or more single binding sites for different targets. In some embodiments, the multivalent and multispecific complex has a single binding site for a target on a leukocyte. In some embodiments, the multivalent and multispecific complex has a single binding site for a target on a T-cell. In some embodiments, the multivalent and multispecific complex has a single binding site for CD3. In further embodiments, complex has a single binding site for CD3 epsilon. In additional embodiments, the complex has a single binding site for a target on a natural killer cell. In additional embodiments, the complex has multiple binding sites for a target on a diseased cell. In some embodiments, the complex has multiple binding sites for 2, 3, 4, 5 or more targets on a diseased cell. In additional embodiments, the complex has multiple binding sites for a target on a tumor cell. In further embodiments, the complex has multiple binding sites for 2, 3, 4, 5 or more targets on a tumor cell. In some embodiments, the complex has multiple binding sites for a target on an immune cell. In further embodiments, the complex has multiple binding sites for 2, 3, 4, 5 or more targets on an immune cell. In some embodiments, the complex has a single binding site for a target on a natural killer cell. In some embodiments, the complex binds a target on a leukocyte and a target on a tumor cell. In some embodiments, the complex binds CD3 and CD19. In further embodiments, the complex has multiple binding sites for a target on an infectious agent or a cell infected with an infectious agent. In further embodiments, the complex has multiple binding sites for 2, 3, 4, 5 or more targets on an infectious agent or a cell infected with an infectious agent. In some embodiments, the complex has a single binding site for a target associated with an endogenous blood brain barrier (BBB) receptor mediated transport system. In further embodiments, the complex has multiple binding sites for a target associated with an endogenous BBB receptor mediated transport system. In some embodiments, the complex has multiple binding sites for 2, 3, 4, 5 or more targets associated with an endogenous BBB receptor mediated transport system. In some embodiments, the single binding site is an MRD. In some embodiments, the single binding site is an antigen binding domain.

In some embodiments, the complexes of the invention comprise a cytotoxic agent.

Polynucleotide encoding a heavy chain or light chain of the MRD containing antibody of the invention, vectors comprising these polynucleotides and host cells containing these vectors and/or polynucleotides are also encompassed by the invention The following examples are intended to illustrate but not limit the invention.

EXAMPLES

Example 1. Integrin Targeting Antibody-MRD Molecules

Novel antibody-MRD fusion molecules were prepared by fusion of an integrin αvβ3-targeting peptides to catalytic antibody 38C2. Fusions at the N-termini and C-termini of the light chain and the C-termini of the heavy chain were most effective. Using flow cytometry, the antibody conjugates were shown to bind efficiently to integrin αvβ3-expressing human breast cancer cells. The antibody conjugates also retained the retro-aldol activity of their parental catalytic antibody 38C2, as measured by methodol and doxorubicin prodrug activation. This demonstrates that cell targeting and catalytic antibody capability can be efficiently combined for selective chemotherapy.

Example 2. Angiogenic Cytokine Targeting Antibody-MRD Molecules

Angiogenic cytokine targeting antibody-MRD fusion molecules were constructed. The antibody used was 38C2, which was fused with a MRD containing the 2×Con4 peptide (AQQEECEWDPWTCEH-MGSGSATGGSGSTASSGSGSATHQEEC EWDPWTC EHMLE (SEQ ID NO:10)). The MRD-containing peptide was fused to either the N- or C-terminus of the light chain and the C-terminus of the heavy chain. Similar results were found with the other Ang2 MRD peptides. Additional Ang2 MRD peptides include: MGAQTNFMPMDNDELLLYEQ-FILQQGLEGGSGSTASSGSGSSLGAQT NFMPMDN-DELLLY (SEQ ID NO:20) (LM-2x-32); and AQQEECE-WDPWTCEHM GSGSATGGSGSTASSGSGSATHQEECEWDPWTCEH-MLE (SEQ ID NO:10) (2×Con4).

One of skill in the art, given the teachings herein, will appreciate that other such combinations will create functional Ang2 binding MRDs as described herein.

Example 3. Antibody-MRD Fusions with Non-Catalytic Antibodies

A humanized mouse monoclonal antibody, LM609, directed towards human integrin αvβ3 has been previously described (Rader, C. et. al., *PNAS* 95:8910-5 (1998)).

Figure 3:
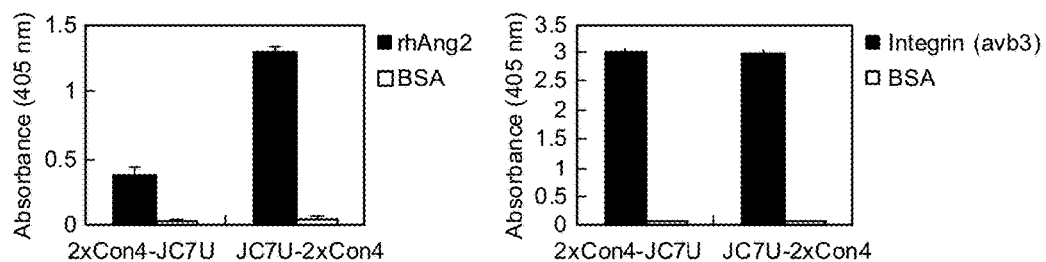
FIG. 3 depicts the results of an enzyme linked immunosorbent assay (ELISA) in which integrin and Ang2 were bound by an anti-integrin antibody (JC7U) fused to an Ang2 targeting MRD (2×Con4).
Figure 4:
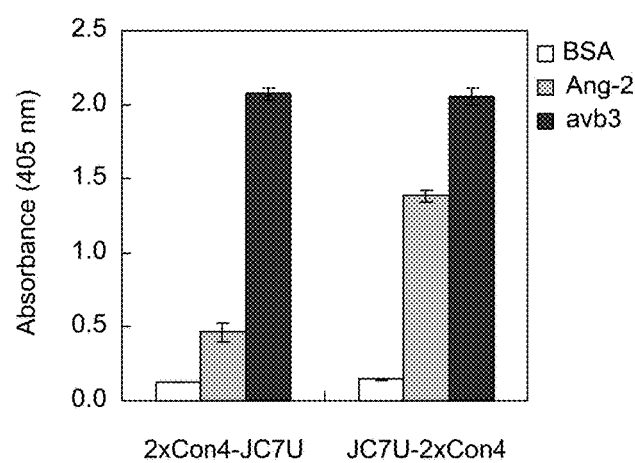
FIG. 4 depicts the results of an ELISA in which integrin and Ang2 were bound by an anti-integrin antibody (JC7U) fused to an Ang2 targeting MRD (2×Con4).

A human non-catalytic monoclonal Ab, JC7U was fused to an anti-Ang2 MRD containing 2×Con4 (AQQEECEWD-PWTCEHMGSGSATGGSGSTASSGSGSATHQEEC EWDPWTCEH MLE (SEQ ID NO:10)) at either the N- or C-terminus of the light chain. 2×Con4 (AQQEECEWDP-WTCEHMGSGSATGGSGSTASSGSGSATHQEECEWD-PWT CEHMLE (SEQ ID NO:10)) was studied as an N-terminal fusion to the Kappa chain of the antibody (2×Con4-JC7U) and as a C-terminal fusion (JC7U-2×Con4). Both fusions maintained integrin and Ang2 binding. As shown in the left panel of FIG. 3, both antibody constructs (2×Con4-JC7U and JC7U-2×Con4) specifically bound to recombinant Ang2 as demonstrated by ELISA studies. Binding to Ang2, however, is significantly higher with JC7U-2×Con4, which has the 2×Con4 (SEQ ID NO:10) fusion at the C-terminus of the light chain of the antibody. The right panel of FIG. 3 depicts the binding of Ang2-JC7U and JC7U-Ang2 to integrin αvβ3. The results show that fusion of 2×Con4 (SEQ ID NO:10) to either the N- or the C-light chain terminus does not affect mAb JC7U binding to integrin αvβ3. FIG. 4 depicts another ELISA study using the same antibody-MRD fusion constructs.

Example 4. HERCEPTIN®-MRD Fusion Molecules

Another example of MRD fusions to a non-catalytic antibody are HERCEPTIN®-MRD fusion constructs. The HERCEPTIN®-MRD fusions are multifunctional, both small molecule αv integrin antagonists and the chemically programmed integrin-targeting antibody show remarkable efficacy in preventing the breast cancer metastasis by interfering with αv-mediated cell adhesion and proliferation. MRD fusions containing HERCEPTIN®-2×Con4 (which targets ErbB2 and Ang2) and HERCEPTIN®-V114 (which targets ErbB2 and VEGF targeting) and HERCEPTIN®-RGD-4C-2×Con4 (which targets ErbB2, ang2, and integrin targeting) are effective.

Example 5. VEGF Targeting Antibody-MRD Molecules

An antibody containing an MRD that targets VEGF was constructed. A MRD which targets vl 14 (SEQ ID NO:13) was fused at the N-terminus of the kappa chain of 38C2 and HERCEPTIN® using a linker. Expression and testing of the resulting antibody-MRD fusion constructs demonstrated strong VEGF binding.

Example 6. IGF1R Targeting Antibody-MRD Molecules

Fusion of an MRD which targets IGF1R (SFY-SCLESLVNGPAEKSRG QWDGCRKK (SEQ ID NO:14)) to the N-terminus of the kappa chain of 38C2 and HER-CEPTIN® using the long linker sequence as a connector was studied. Expression and testing of the resulting antibody-MRD fusion constructs demonstrated strong IGF1R binding. Additional clones showing high binding to IGR1R were identified after several rounds of mutagenesis and screening of the regions described in Table 4. The preferred sequences listed in Table 5 bind IGF1R and show no significant or no binding affinity to the insulin receptor, thereby suggesting specificity for IGF1R.

TABLE 4

Template for further mutagenesis.

| Name | DNA | AA |
|---|---|---|
| Rm2-2-218 | GTGGAGTGCAGGGCGCCG (SEQ ID NO: 50) | VECRAP (SEQ ID NO: 51) |
| Rm2-2-316 | GCTGAGTGCAGGGCTGGG (SEQ ID NO: 52) | AECRAG (SEQ ID NO: 53) |
| Rm2-2-319 | CAGGAGTGCAGGACGGGG (SEQ ID NO: 54) | QECRTG (SEQ ID NO: 55) |

TABLE 5

| Mutant | Amino acid sequence | Template | SEQ ID NO |
|---|---|---|---|
| Rm4-31 | NFYQCIEMLASHPAEKSRGQWQECRTGG | Rm2-2-319 | 35 |
| Rm4-33 | NFYQCIEQLALRPAEKSRGQWQECRTGG | Rm2-2-319 | 36 |
| Rm4-39 | NFYQCIDLLMAYPAEKSRGQWQECRTGG | Rm2-2-319 | 37 |
| Rm4-310 | NFYQCIERLVTGPAEKSRGQWQECRTGG | Rm2-2-319 | 38 |
| Rm4-314 | NFYQCIEYLAMKPAEKSRGQWQECRTGG | Rm2-2-319 | 39 |
| Rm4-316 | NFYQCIEALQSRPAEKSRGQWQECRTGG | Rm2-2-319 | 40 |
| Rm4-319 | NFYQCIEALSRSPAEKSRGQWQECRTGG | Rm2-2-319 | 41 |
| Rm4-44 | NFYQCIEHLSGSPAEKSRGQWQECRTG | Rm2-2-319 | 42 |
| Rm4-45 | NFYQCIESLAGGPAEKSRGQWQECRTG | Rm2-2-319 | 43 |
| Rm4-46 | NFYQCIEALVGVPAEKSRGQWQECRTG | Rm2-2-319 | 44 |
| Rm4-49 | NFYQCIEMLSLPPAEKSRGQWQECRTG | Rm2-2-319 | 45 |
| Rm4-410 | NFYQCIEVFWGRPAEKSRGQWQECRTG | Rm2-2-319 | 46 |
| Rm4-411 | NFYQCIEQLSSGPAEKSRGQWQECRTG | Rm2-2-319 | 47 |
| Rm4-415 | NFYQCIELLSARPAEKSRGQ WAECRAG | Rm2-2-316 | 48 |
| Rm4-417 | NFYQCIEALARTPAEKSRGQWVECRAP | Rm2-2-218 | 49 |

Example 7. ErbB2 Binding, Ang2-Targeting Antibody-MRD Molecules

Figure 5:
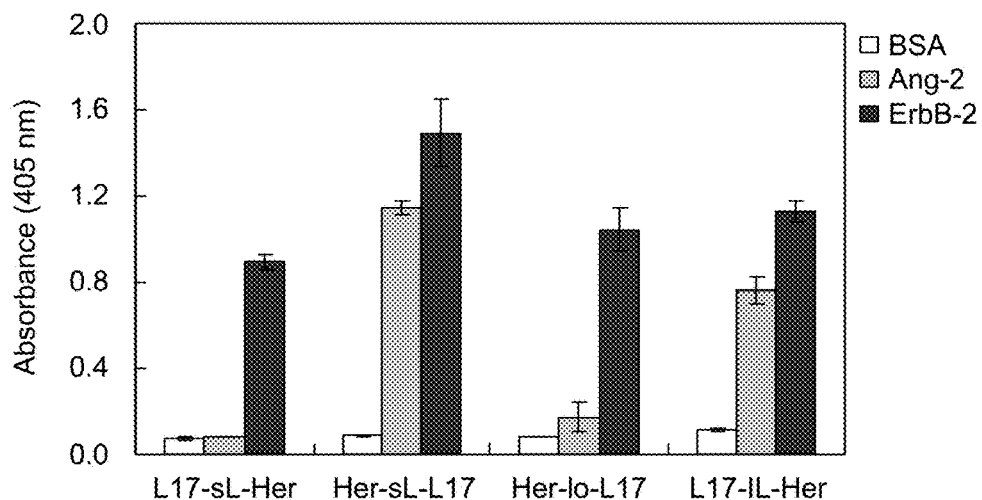
FIG. 5 depicts the results of an ELISA in which an anti-ErbB2 antibody was fused to an MRD which targets Ang2.

An antibody was constructed which contains an MRD that targets Ang2 (L17) (SEQ ID NO:7) fused to the light chain of an antibody which binds to ErbB2. Either the short linker sequence, the long linker sequence, or the 4th loop in the light chain constant region was used as a linker. FIG. 5 depicts the results of an ELISA using constructs containing an N-terminal fusion of an Ang2 targeting MRD with the ErbB2 antibody with the short linker peptide (GGGS (SEQ ID NO:1)) (L17-sL-Her), a C-terminal fusion of Ang2 targeting MRD with the ErbB2 antibody with the short linker peptide (Her-sL-L17), a C-terminal fusion of Ang2 targeting MRD with the ErbB2 antibody with the 4th loop in the light chain constant region (Her-lo-L17), or an N-terminal fusion of Ang2 targeting MRD with the ErbB2 antibody with the long linker peptide (SSGGGGSGGGGGGSSRSS (SEQ ID NO:19)) (L17-1L-Her). ErbB2 was bound with varying degrees by all of the constructs. However, Ang2 was bound only by Her-sL-L17 and L17-1L-Her.

Figure 6:
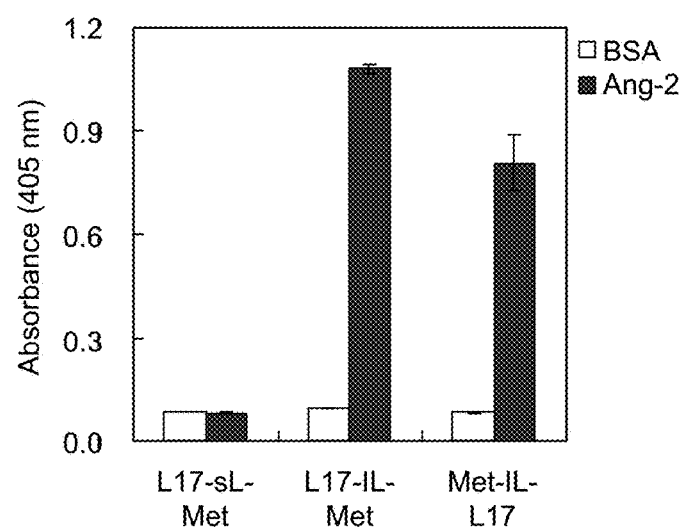
FIG. 6 depicts the results of an ELISA in which an Ang2 targeting MRD was fused to a hepatocyte growth factor receptor (cMET) binding antibody.

Example 8. Hepatocyte Growth Factor Receptor Binding, Ang2-Targeting Antibody-MRD Molecules Fusion of an MRD which targets Ang2 (L17) (SEQ ID NO:7) was made to either the N-terminus or C-terminus of the light chain of the Met antibody, which binds to hepatocyte growth factor receptor. Either the short linker sequence or the long linker sequence were used as a connector. FIG. 6 depicts the results of an ELISA using constructs containing N-terminal fusion of Ang2 targeting MRD with the Met antibody with the short linker peptide (GGGS (SEQ ID NO:1)) (L17-sL-Met), N-terminal fusion of Ang2 targeting MRD with the Met antibody with the long linker peptide (SSGGGGSGGGGGGSSRSS (SEQ ID NO:19)) (L17-1L-Met), and C-terminal fusion of Ang2 targeting MRD with the Met antibody with the long linker peptide (Met-ILL17). Expression and testing of the resulting antibody-MRD fusion constructs demonstrated strong Ang2 binding when the long linker peptide was used. Fusion of the Ang2 targeting MRD to the C-light chain terminus of the antibody resulted in slightly higher binding to Ang2 then fusion of the Ang2 targeting to the N-light chain terminus of the antibody.

Example 9. ErbB2 Binding, Integrin-Targeting Antibody-MRD Molecules

Figure 7:
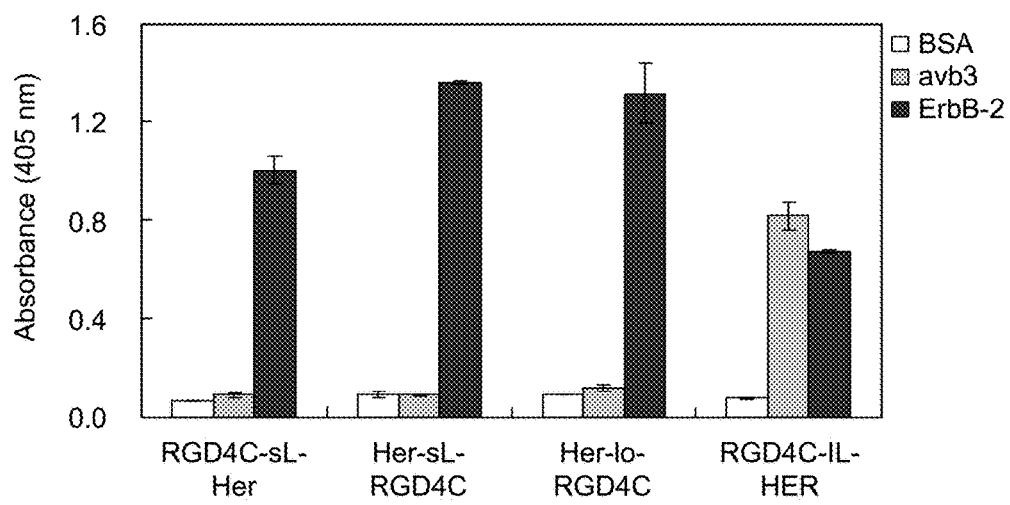
FIG. 7 depicts the results of an ELISA in which an integrin targeting MRD was fused to an ErbB2-binding antibody.

An antibody was constructed which contains an MRD that targets integrin αvβ3 (RGD4C) with the sequence CDCRGDCFC (SEQ ID NO:106) fused to the light chain of an antibody HERCEPTIN® which binds to ErbB2 (Her). Either the short linker sequence, the long linker sequence, or the 4th loop in the light chain constant region was used as a linker. FIG. 7 depicts the results of an ELISA using constructs containing an N-terminal fusion of integrin αvβ3 targeting MRD with the ErbB2 antibody with the short linker peptide (GGGS (SEQ ID NO:1)) (RGD4C-sL-Her), a C-terminal fusion of integrin αvβ3 targeting MRD with the ErbB2 antibody with the short linker peptide (Her-sL-RGD4C), a C-terminal fusion of integrin αvβ3 targeting MRD with the ErbB2 antibody with the 4th loop in the light chain constant region (Her-lo-RGD4C), or an N-terminal fusion of integrin αvβ3 targeting MRD with the ErbB2 antibody with the long linker peptide (SSGGGGSGGGGGGSSRSS (SEQ ID NO:19)) (RGD4C-1L-Her). ErbB2 was bound with varying degrees by all of the constructs. However, integrin αvβ3 was bound only by RGD4C-1L-Her.

Figure 8:
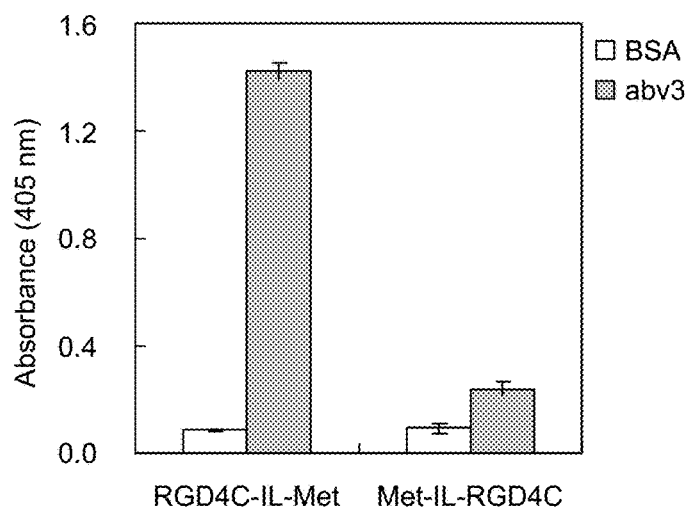
FIG. 8 depicts the results of an ELISA in which an integrin targeting MRD was fused to a hepatocyte growth factor receptor binding antibody.

Example 10. Hepatocyte Growth Factor Receptor Binding, Integrin-Targeting Antibody-MRD Molecules An antibody was constructed which contains an MRD that targets integrin αvβ3 (RGD4C) (SEQ ID NO:106) fused to the light chain of an antibody which binds to the hepatocyte growth factor receptor (Met). Antibody-MRD constructs containing the long linker sequence were used. FIG. 8 depicts the results of an ELISA using constructs containing an N-terminal fusion of integrin αvβ3 targeting MRD with the hepatocyte growth factor receptor antibody (RGD4C-1L-Met), or a C-terminal fusion of integrin αvβ3 targeting MRD with the hepatocyte growth factor receptor antibody (Met-1L-RGD4C). The RGD4C-1L-Met demonstrated strong integrin αvβ3 binding.

Figure 9:
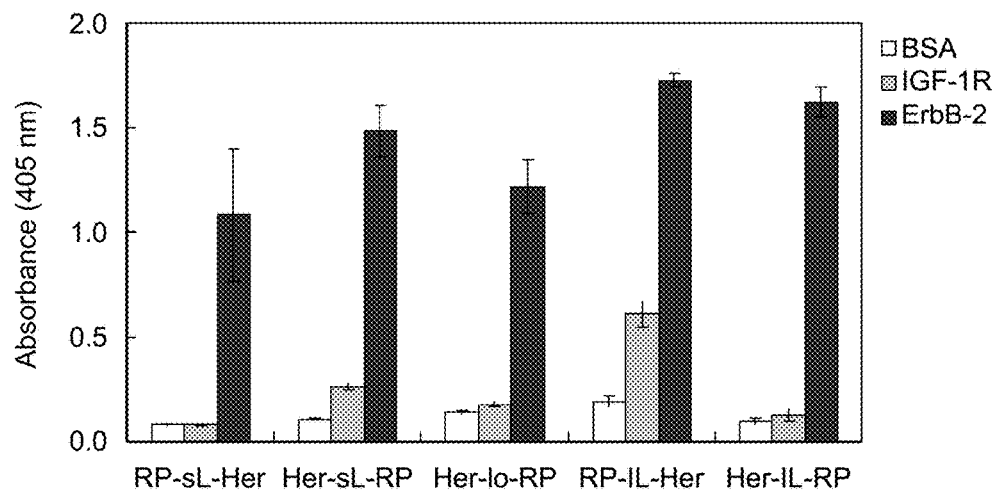
FIG. 9 depicts the results of an ELISA in which an insulin-like growth factor-I receptor targeting MRD was fused to an ErbB2-binding antibody.

Example 11. ErbB2 Binding, Insulin-Like Growth Factor-I Receptor-Targeting Antibody-MRD Molecules Antibodies were constructed which contains an MRD that targets insulin-like growth factor-I receptor (RP) (SEQ ID NO:14) fused to the light chain of an antibody which binds to ErbB2 (Her). Either the short linker peptide, the long linker peptide, or the 4th loop in the light chain constant region was used as a linker (Carter et al., Proc. Natl. Acad. Sci. USA 89:4285-4289 (1992); U.S. Pat. No. 5,677,171; and ATCC Deposit 10463, each of which is herein incorporated by reference). FIG. 9 depicts the results of an ELISA using constructs containing an N-terminal fusion of insulin-like growth factor-I receptor targeting MRD with the ErbB2 antibody with the short linker peptide (RP-sL-Her), a C-terminal fusion of insulin-like growth factor-I receptor targeting MRD with the ErbB2 antibody and the short linker peptide (Her-sL-RP), a C-terminal fusion of insulin-like growth factor-I receptor targeting MRD with the ErbB2 antibody with the 4th loop in the light chain constant region (Her-lo-RP), an N-terminal fusion of insulin-like growth factor-I receptor targeting MRD with the ErbB2 antibody with the long linker peptide (RP-1L-Her), or a C-terminal fusion of insulin-like growth factor-1 receptor targeting MRD with the ErbB2 antibody with the long linker peptide (Her-1L-RP). ErbB2 was bound with varying degrees by all of the constructs. Insulin-like growth factor-I receptor was bound by RP-1L-Her.

Example 12. ErbB2 Binding. VEGF-Targeting Antibody-MRD Molecules

Figure 10:
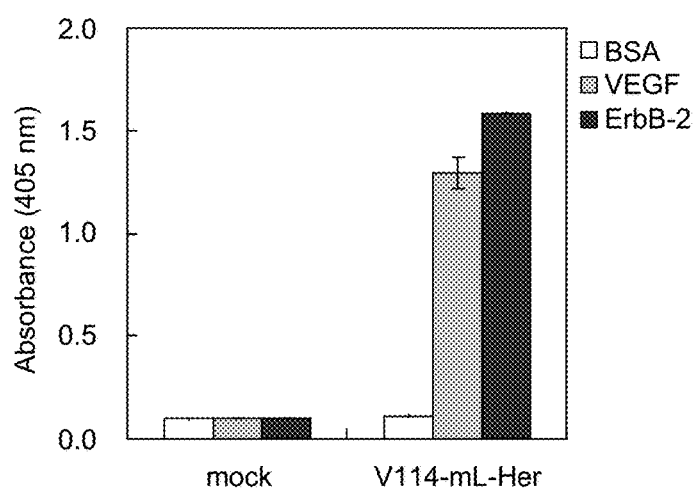
FIG. 10 depicts the results of an ELISA in which a VEGF-targeting MRD was fused to an ErbB2-binding antibody.

Fusion of an MRD which targets VEGF (Vl 14) (SEQ ID NO:13) (Fairbrother W. J., et al., Biochemistry 37:177754-177764 (1998)) was made to the N-terminus of the light chain of a ErbB2-binding antibody (Her). A medium linker peptide (SSGGGGSGGGGGSS (SEQ ID NO:2)) was used as a connector. FIG. 10 depicts the results of an ELISA using a construct containing an N-terminal fusion of VEGF targeting MRD with the ErbB2-binding antibody with the medium linker peptide (Vl 14-mL-Her). Expression and testing of the resulting antibody-MRD fusion construct demonstrated strong VEGF and ErbB2 binding.

Example 13. Integrin Targeting Antibody-MRD Molecules

Figure 11:
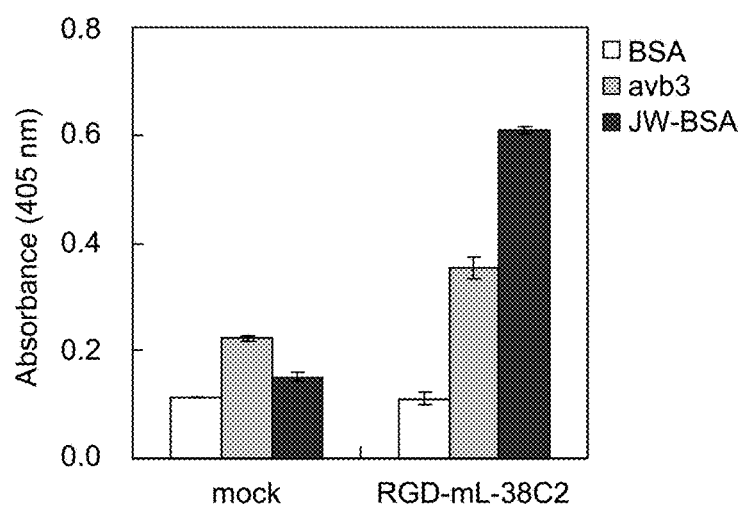
FIG. 11 depicts the results of an ELISA in which an integrin targeting MRD was fused to a catalytic antibody.

Fusion of an MRD which targets integrin αvβ3 (RGD) (SEQ ID NO:106) to the N-terminus of the light chain of 38C2 using the medium linker peptide as a connector was studied. FIG. 11 demonstrates that expression and testing of the resulting antibody-MRD fusion construct had strong integrin αvβ3 binding.

Example 14. Ang2 Targeting Antibody-MRD Molecules

Figure 12:
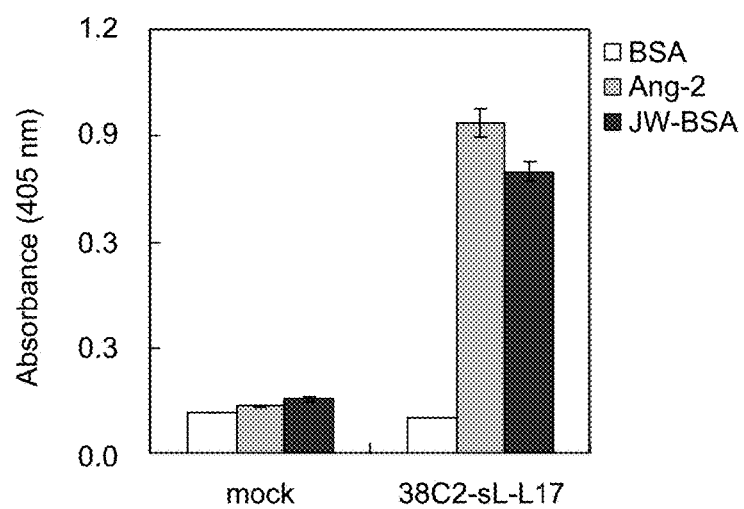
FIG. 12 depicts the results of an ELISA in which an Ang2-targeting MRD was fused to a catalytic antibody.

Fusion of an MRD which targets Ang2 (L 17) (SEQ ID NO:7) to the C-terminus of the light chain of 38C2 using the short linker sequence as a connector was studied. FIG. 12 demonstrates that expression and testing of the resulting antibody-MRD fusion construct had strong Ang2 binding.

Figure 13:
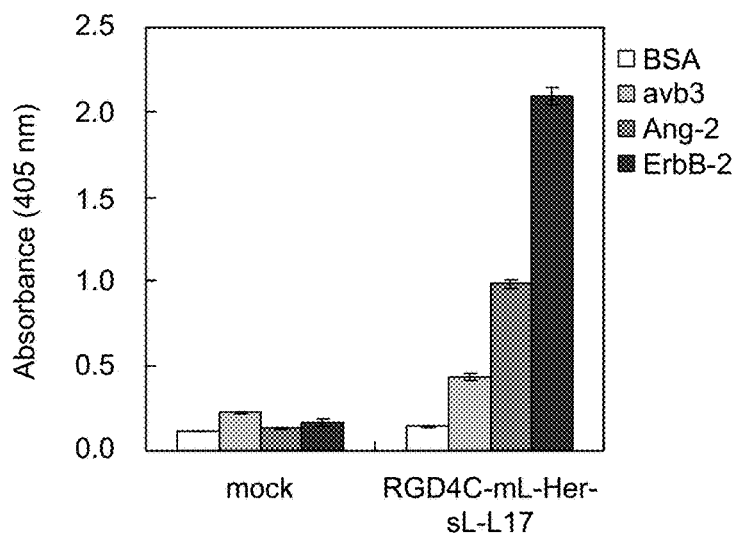
FIG. 13 depicts the results of an ELISA in which an integrin targeting MRD and an Ang2 targeting MRD were fused to an ErbB2-binding antibody.

Example 15. ErbB2 Binding, Integrin and Ang2 Targeting Antibody-MRD Molecules An MRD which targets integrin αvβ3 (RGD4C) was connected to the N-terminus of the light chain of an ErbB2 targeting antibody (Her) with a medium linker, and an Ang2 (L17) targeting MRD was connected by a short linker to the C-terminus of the same ErbB2 targeting antibody (RGD4C-mL-Her-sL-L17). FIG. 13 demonstrates that the resulting antibody-MRD fusion construct bound to integrin, Ang2, and ErbB2.

Similarly, ErbB2 targeting antibodies (e.g., Her) with an IGF-1R MRD fused to the C-terminus of the heavy chain or the N-terminus of the light chain bound to immobilized IGF-1R at comparable rates. In addition, ErbB2 targeting antibodies containing an IGF-1R MRD fused to the N-terminus of the light chain and an Ang2 MRD fused to the C-terminus of the heavy chain bound to immobilized IGF-1R at comparable rates. Each of these three multivalent and multispecific compositions (e.g., MRD-containing antibodies) also inhibited the binding of IGF-1 to immobilized IGF-IR. The trispecific molecule (HERCEPTIN with 1GF-1R and Ang2 MRDs) bound to both cell surface ErbB2 and soluble Ang2.

Example 16. ErbB2 Binding, Integrin-Targeting Antibody-MRD Molecules

Figure 14:
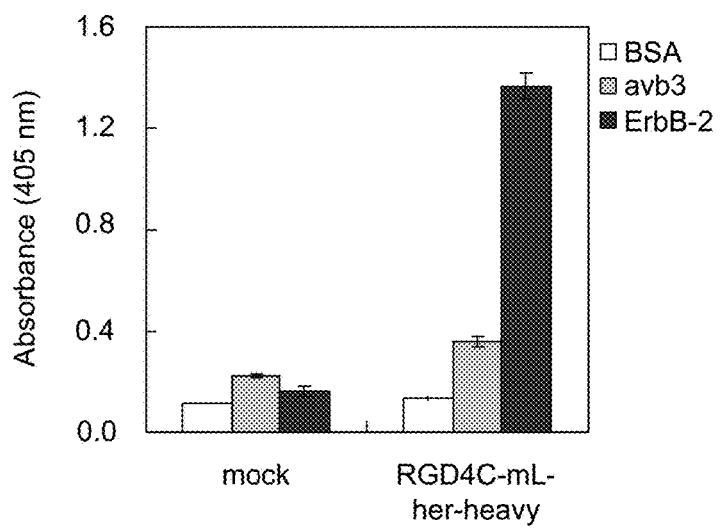
FIG. 14 depicts the results of an ELISA in which an integrin targeting MRD was fused to an ErbB2-binding antibody.

An antibody was constructed which contains an MRD that targets integrin αvβ3 (RGD4C) fused to the N-terminus of the heavy chain of an antibody which binds to ErbB2 (Her) using the medium linker as a connector (RGD4C-mL-her-heavy). FIG. 14 depicts the results of an ELISA using the construct. Both integrin and ErbB2 were bound by the construct.

Figure 15:
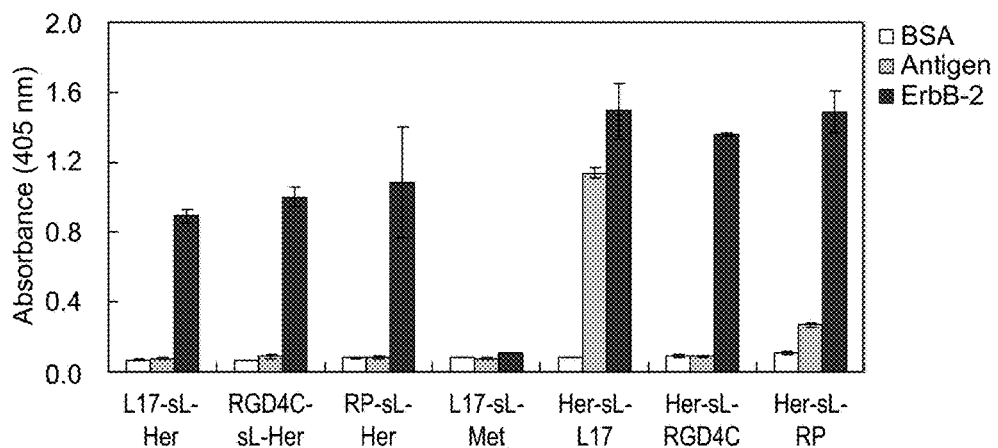
FIG. 15 depicts the results of an ELISA in which an integrin, Ang2, or insulin-like growth factor-I receptor-targeting MRD was fused to an ErbB2 or hepatocyte growth factor receptor-binding antibody with a short linker peptide.

Example 17. ErbB2 or Hepatocyte Growth Factor Receptor Binding, and Integrin, Ang2 or Insulin-Like Growth Factor-I Receptor-Targeting Antibody-MRD Molecules with the Short Linker Peptide Antibody-MRD molecules were constructed which contain ErbB2 or hepatocyte growth factor receptor binding antibodies, and integrin αvβ3, Ang2 or insulin-like growth factor-I receptor-targeting MRD regions were linked with the short linker peptide to the light chain of the antibody. FIG. 15 depicts the results of an ELISA using constructs containing an N-terminal fusion of Ang2 targeting MRD fused to the ErbB2 antibody (L17-sL-Her), an N-terminal fusion of integrin-targeting MRD with the ErbB2 antibody (RGD4C-sL-Her), an N-terminal fusion of insulin-like growth factor-I receptor targeting MRD with the ErbB2-binding antibody (RP-sL-Her), a C-terminal fusion of Ang2 targeting MRD with the hepatocyte growth factor receptor binding antibody (L17-sL-Met), a C-terminal fusion of Ang2 targeting MRD with the ErbB2-binding antibody (Her-sL-L17), a C-terminal fusion of integrin targeting MRD with the ErbB2-binding antibody (Her-sL-RGD4C), or a C-terminal fusion of insulin-like growth factor-I receptor targeting MRD with the ErbB2-binding antibody (Her-sL-RP). ErbB2 was bound with varying degrees by the antibody-MRD constructs, with the exception of the construct containing the hepatocyte growth factor receptor-binding antibody. Antigen was bound only by the Her-sL-L17 construct.

Figure 16:
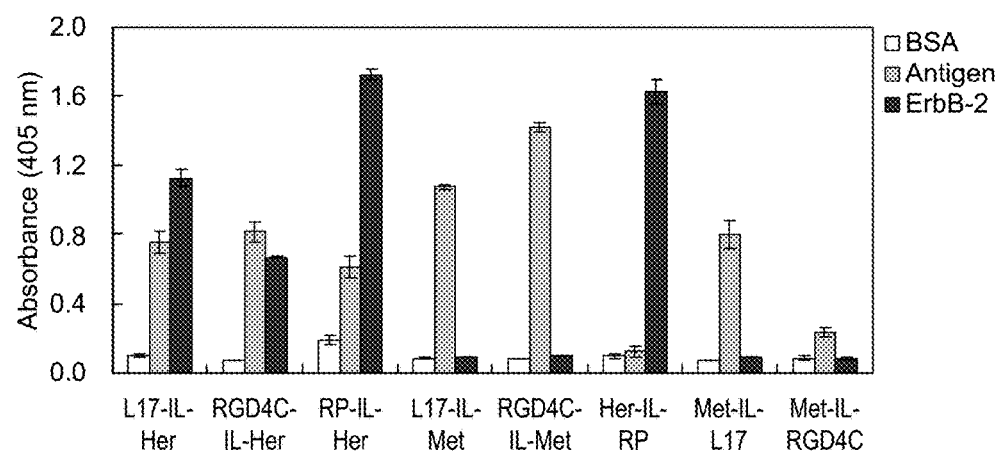
FIG. 16 depicts the results of an ELISA in which an integrin, Ang2, or insulin-like growth factor-I receptor-targeting MRD was fused to an ErbB2 or hepatocyte growth factor receptor-binding antibody with a long linker peptide.

Example 18. ErbB2 or Hepatocyte Growth Factor Receptor Binding, and Integrin, Ang2 or Insulin-Like Growth Factor-I Receptor-Targeting Antibody-MRD Molecules with the Long Linker Peptide Antibody-MRD molecules were constructed which contain ErbB2 or hepatocyte growth factor receptor binding antibodies, and integrin $\alpha v \beta 3$, Ang2 or insulin-like growth factor-I receptor-targeting MRD regions linked with the long linker peptide to the light chain of the antibody. FIG. 16 depicts the results of an ELISA using constructs containing an N-terminal fusion of Ang2 targeting MRD fused to the ErbB2 antibody (L17-1L-Her), an N-terminal fusion of integrin-targeting MRD with the ErbB2 antibody (RGD4C-1L-Her), an N-terminal fusion of insulin-like growth factor-I receptor-targeting MRD with the ErbB2-binding antibody (RP-1L-Her), a C-terminal fusion of Ang2 targeting MRD with the hepatocyte growth factor receptor binding antibody (L17-1L-Met), a C-terminal fusion of integrin targeting MRD with the hepatocyte growth factor receptor binding antibody (RGD4C-1L-Met), a C-terminal fusion of Ang2 targeting MRD with the insulin-like growth factor-I receptor binding antibody (Her-1L-RP), a C-terminal fusion of Ang2 targeting MRD with the hepatocyte growth factor receptor binding antibody (Met-1L-L17), or a C-terminal fusion of integrin targeting MRD with the hepatocyte growth factor receptor binding antibody (Met-1L-RGD4C). As shown in FIG. 16, antibody-MRD fusions are effective to bind antigen and ErbB2. Lu et al., J. Biol. Chem. 20:280(20):19665-19672 (2005); Lu et al., J. Biol. Chem.: 279(4):2856-65 (2004).

Example 19. Cloning and Expression of Ang2 MRDs Fused to Maltose Binding Protein A. Cloning of MBP Fusions Monomer and dimer peptides were expressed as protein fusions to maltose binding protein (MBP) using a modified form of the pMAL-p2 vector and expression system from New England Biolabs (NEB; Beverly, Mass.) The PCR-generated MRD sequence was inserted into a pMAL vector down-stream from the malE gene, which encodes MBP. This results in a vector that encodes an MRD-MBP-fusion protein. The pMAL vector contains a strong Ptac promoter and is inducible by IPTG. The pMAL-p2 series contains the normal malE signal sequence, which directs the fusion protein through the cytoplasmic membrane. pMAL-p2 fusion proteins capable of being exported can be purified from the periplasm through osmotic shock. Further purification can be performed, for example by binding to amylose resin.

B. Expression of MBP Fusion Proteins and Osmotic Shock Fractionation

For expression of fusion proteins, bacterial cultures grown overnight were back-diluted into fresh media to an OD A600 of approximately 0.1. Cultures were grown to an OD of approximately 0.8 and induced with IPTG at a concentration of 0.3 mM. Cultures were incubated with shaking for approximately 4 hours, after which bacteria were centrifuged for 15 minutes at 4700 g. Pelleted bacteria were resuspended in 30 mM Tris-HCL pH 7.4, 20% sucrose, 1 mM EDTA. Cells were incubated for 20 minutes at room temperature (RT) prior to centrifugation for 15 minutes at 4700 g. Pelleted bacteria were then resuspended in ice cold $MgSO_4$, and incubated for 20 minutes on ice, with periodic mixing. Cell suspensions were sonicated (Misonix XL2020) for 90 seconds. Cells were centrifuged at 4° C. for 20 minutes at 4700 g. The supernatant ("osmotic shock fraction") was adjusted to 1×PBS using 10×PBS (Quality Biologics, cat #119-069-131) and filtered through 0.2 micron filter. These osmotic shock fractions were assayed directly for binding to Ang2.

C. Direct Binding of MBP Fusion Proteins

For detection of direct binding of MRD-MBP fusions to Ang2, the following ELISA was performed. Ninety-six-well plates were coated overnight with rhAng2 (R&D cat#623-AN) at 320 ng/ml (100W/well). Wells were blocked for 3.25 hours with 250 µl Blocking buffer (Thermo Cat# N502), followed by 4 washes with 300 µl wash buffer (PBS, 0.1% tween). MBP fusion proteins were serially diluted in Blocking buffer and added to wells for 2 hours at RT. After washing (8×300 µl wash buffer), samples were treated with HRP-mouse anti MBP mAb (NEB, cat # E8038S), diluted 1:4000 in Blocking buffer. After incubation for 1 hour at RT, wells were washed (8×300 µl wash buffer) prior to receiving 100 µl of TMB substrate (KPL Laboratories). Color development was stopped with 100 µl of $H_2SO_4$, and absorbance was read at 450 nm.

D. Results

MRD-MBP fusions were assayed for direct binding to Ang2. Osmotic shock fractions of induced bacterial cultures were serially diluted and added to Ang2 coated wells. Bound fusion proteins were detected with anti-MBP mAb. The dose response curves are presented in FIG. 17A. Assayed proteins represent mutational variants of the sequence MGAQTNF-MPMDDDE LLLYEQFILQQGLE (L17D) (SEQ ID NO:107). In this series, the motif MDD within L17D was mutated at the first D to all other possible amino acids (except cysteine). Other MRDs tested were "Lm32 KtoS" and a dimer of Lm32 (2×Lm32). As presented in FIG. 17B, several MXD mutants exhibit binding in the 0.1 to 100 nm range. The Lm32 dimer (2×Lm32) exhibits greater than 10 fold higher affinity for Ang2 than either L17D or "Lm32 KtoS".

Example 21. Expression and Purification of Antibodies Containing MRDs

Molecular recognition domains were constructed and expressed in a pcDNA 3.3 vector as fusion proteins with either the heavy or light chains of antibodies. For protein production, plasmid DNAs encoding the heavy and light chains of the antibodies containing MRDs were first transformed into chemically competent bacteria in order to produce large amounts of DNA for transient transfection. Single transformants were propagated in LB media and purified using Qiagen's Endotoxin Free Plasmid Kits. Briefly, cells from an overnight culture were lysed; lysates were clarified and applied to an anion-exchange column, and then subjected to a wash step and eluted with high salt. Plasmids were precipitated, washed, and resuspended in sterile water.

HEK293T cells were expanded to the desired final batch size (about 5 L) prior to transfection. The purified plasmid (1 mg per liter of production) was complexed with the polyethylenimine (PEI) transfection reagent, added to the shake flask culture, and incubated at 37° C. The culture was monitored daily for cell count, cell diameter, and viability. The conditioned medium was harvested and stored at −80° C. until purification.

Antibodies containing MRDs were purified from the conditioned medium using affinity chromatography. Culture supernatant was filter clarified and applied directly to a chromatography column containing recombinant Protein A Sepharose (GE Healthcare). The column was washed, and bound antibodies containing MRDs were eluted by lowering buffer pH. Following elution, eluate fractions were immediately adjusted to physiologic pH. Following Protein A affinity purification, an additional optional polishing chromatographic step can be performed as needed.

Purified proteins were dialyzed into PBS, concentrated to ~1-4 mg/ml, sterile filtered, aliquoted aseptically, and stored frozen at −80° C. All steps of the purification were monitored by SDS-PAGE-Coomassie, and precautions were taken during the purification to keep endotoxin levels as minimal as possible.

The final product was analyzed for endotoxin levels (EndoSafe), purity (SDS-PAGE-coomassie, analytical SEC-HPLC), protein identity (Western blot), and yield (Bradford assay). An additional size exclusion HPLC analysis was performed to assess the level of aggregates.

The data presented in Table 6 indicate that the antibodies containing MRDs can be expressed and purified using conventional techniques.

TABLE 6

| Zybody | Yield (mg) | Purity | Aggregates (%) | Endotoxin (EU/ml) |
| --- | --- | --- | --- | --- |
| HER2xCon4(H) | 36 | >90% | 4.6 | <1 |
| HER-lm32(H) | 57 | >90% | 1 | 2.02 |
| HER-lm32(L) | 98 | >90% | 2 | 3.26 |
| AVA-lm32(H) | 12 | >90% | 0 | <1 |

Example 22. Simultaneous Binding of HER Lm32(H) and HER Lm32 (L) to Her2 and Ang2

A. Methods

Ninety-six-well plates were coated overnight with rHER2-Fc (R&D cat#1129-ER-050) at 20 ng/ml (100 µl/well). Wells are blocked for 3.25 hours with 250 µl Blocking buffer (Thermo Cat# N502), followed by 4 washes with 300 µl wash buffer (PBS, 0.1% tween). Antibodies containing MRDs (HER-lm32(H), HER-lm32(L), and AVA-lm32(H)) and antibodies (HERCEPTIN®) were serially diluted in Blocking buffer, containing 1.94 µg/ml biotinylated Ang2 (R&D cat#BT633) and added to wells for 2 hours at RT. After washing (8×300 µl wash buffer), parallel samples received either HRP-conjugated anti-human kappa chain mAb-(Abcam, cat # ab79115-1) diluted 1:1000 in Blocking buffer or HRP-conjugated streptavidin (Thermo Scientific cat#N100) diluted 1:4000 diluted in Blocking buffer. After incubation for 1 hour at RT, wells were washed (8×300 µl wash buffer) prior to receiving 100 µl of TMB substrate (KPL Laboratories). Color development was stopped with 100 µl of $H_2SO_4$, and absorbance was read at 450 nm.

B. Results

As detected with anti-human kappa chain mAb, both a HERCEPTIN®-based antibody or HERCEPTIN®-based antibodies containing MRDs bind to Her2 Fc in the presence of Ang2 in a dose dependent manner (FIG. 18A). Only the HERCEPTIN®-based antibodies containing MRDs (HER-lm32(H) and HER-lm32(L)) exhibit simultaneous binding to Her2 Fc and Ang2, as detected by HRP-conjugated streptavidin (FIG. 18B).

Example 23. Simultaneous Binding of AVA-lm32(H) to VEGF and Ang2

A. Methods:

Ninety-six-well plates were coated overnight with human VEGF (PeproTech, Inc. cat#100-20) at 30 ng/ml (100 µl/well). Wells were blocked for 3.25 hours with 250 µl Blocking buffer (Thermo Cat# N502), followed by 4 washes with 300 µl wash buffer (PBS, 0.1% tween). Antibodies containing MRDs (HER-lm32(H) and AVA-lm32(H)) and antibodies (AVASTIN®) were serially diluted in Blocking buffer, containing 3.876 µg/ml biotinylated Ang2 (R&D cat#BT633) and added to wells for 2 hours at RT. After washing (8×300 µl wash buffer), parallel samples received either HRP-conjugated anti-human kappa chain mAb (Abcam, cat # ab79115) diluted 1:1000 in Blocking buffer or HRP-conjugated streptavidin (Thermo Scientific cat#N100) diluted 1:4000 diluted in Blocking buffer. After incubation for 1 hour at RT, wells were washed (8×300 µl wash buffer) prior to receiving 100 of TMB substrate (KPL Laboratories). Color development was stopped with 100 µl of $H_2SO_4$, and absorbance was read at 450 nm.

B. Results

As detected with anti-human kappa chain mAb, both AVASTIN® and AVASTIN®-based antibodies containing MRDs bind to VEGF in the presence of Ang2 in a dose dependent manner (FIG. 19A). Only the AVASTIN®-based antibodies containing MRDs (AVA-lm32(H)) exhibited simultaneous binding to VEGF and Ang2, as detected by HRP-conjugated streptavidin (FIG. 19B).

Example 24. Simultaneous Binding of HER-lm32 (H) and HER-lm32 (L) to HER2 and Angiopoietin-2

The ability of HER-lm32 (H) and HER-lm32 (L) simultaneously bind to Her2 expressed on the surface of breast carcinoma cells BT-474, and to Ang2 in solution, was determined by flow cytometry. Mouse anti-human Ig-FITC was used for detection of the heavy chain of the antibodies containing MRDs, and Ang2-biotin/streptavidin-PE was used for detection of the lm32 MRD. Cells that bind Her2 and Ang2 simultaneously are expected to be detected as double positive for FITC and PE fluorescence.

One million HER2 positive breast carcinoma cells BT-474 were incubated with 1 µg HER-lm32(H) or HER-lm32(L) for 25 minutes at RT. After washing, cells were incubated with 200 ng/mL Ang2 biotin (R&D systems) for 25 minutes at RT and then with 20 µL of mouse anti-human Ig-FITC and Streptavidin-PE for 15 minutes. After washing with 2 mL buffer, cells were analyzed by flow cytometry (FACS Canto 11, BD).

In order to confirm the specificity of binding of HER-lm32(H) and HER-lm32(L) to HER2 on BT-474 cells, binding was determined in the presence of 10-fold excess of HERCEPTIN®. In these experiments, antibodies containing MRDs (1 µg) were incubated with one million BT-474 cells in the absence or presence of 10 µg HERCEPTIN® for 25 minutes at RT. Binding of antibodies containing MRDs to HER2 was determined by incubating with 200 ng/mL Ang2 biotin followed by detection with streptavidin-PE.

The data presented in FIG. 20A demonstrate that both HER-lm32(H) and HER-lm32(L), bind simultaneously to HER2 and Ang2. In both cases, the cells exhibited bright dual fluorescence in the FITC and PE fluorescence channels. The fact that HER-lm32(H) and HER-lm32(L) binding to HER2 is completely inhibited by HERCEPTIN® (FIG. 20B) indicates that the binding is specific.

In addition, tri-specific binding was demonstrated using an antibody containing two distinct MRDs. An EGFR-binding affibody and an Ang2-binding peptide (LM32) were fused to the C-terminus of the light and heavy chains of HERCEPTIN, respectively. The MRD-containing antibody was incubated with the EGFR+, Her2-A431 human epithelial cell line. Cell-bound MRD-containing antibody was detected with biotinylated Ang2/strepavidin-PE, alexafluor labeled ErbB2-Fc, or the combination of Ang2/strepavidin-PE and alexafluor labeled ErbB2-Fc. The results demonstrated that the MRD-containing antibody simultaneously bound EGFR cell surface receptor and two soluble ligands (ErbB2 and Ang2).

Additional experiments demonstrated that a fusion of lm32 to the C-terminus of the heavy chain of HERCEPTIN retained the binding specificity and Fc function of HERCEPTIN. HERCEPTIN and the HERCEPTIN-lm32 fusion bound to FcRn with similar affinities (EC50s for HERCEPTIN and HERCEPTIN lm-32 were 2.17 and 2.84 µg/ml, respectively). The HERCEPTIN and the HERCEPTIN-lm32 fusion displayed comparable ADCC activity on SK-BR-3 cells. The HERCEPTIN-lm32 fusion and HERCEPTIN bound to Fcγ-RI and Fcγ-RIII with similar affinities. The HERCEPTIN-lm32 fusion and HERCEPTIN bound to complement receptor C1q with similar affinities. In addition, the HERCEPTIN-lm32 fusion bound Ang2 with subnanomolar affinity and antagonized Ang2 binding to the Tie-2 receptor. The HERCEPTIN-lm32 fusion bound the extracellular domain of ErbB2 and also inhibited Ang2-induced proliferation of primary bovine lymphoendothelial cells. The HERCEPTIN-lm32 fusion and HERCEPTIN bound to the extracellular domain of Her2 with similar kinetic parameters. Additional experiments demonstrated that the HERCEPTIN-lm32 fusion was as effective as HERCEPTIN in inhibiting the proliferation of several cultured breast cancer cell lines (BT-474, MDA-MB-361 and SK-BR-3). The antiproliferative effect of the HERCEPTIN-lm32 fusion on SK-BR-3 cells was not affected by the presence of Ang2 (2 µg/ml) in the culture.

Simultaneous target binding has been observed for other multivalent and multispecific compositions (e.g., multivalent and multispecific compositions (e.g., MRD-containing antibodies)). For example, a fusion of lm32 to the C-terminus of HUMIRA heavy chain (HUM-lm32(H)) was able to simultaneously bind to Ang2 and TNFα. The same fusion was able to bind 293 cells transiently transfected with full length human TNFα with similar affinity to the HUMIRA antibody. HUM-lm32(H) was also able to inhibit the interaction of TNF with its receptors. HUM-lm32(H) also bound to cell surface expressed and plate bound FcRn as well as to Fcγ-RI and Fcγ-RIII.

Example 25. Antibody-MRDs Containing Heavy Chain Fusions Bind to Targets

To assess the ability of lm32-containing antibodies to block the interaction of Ang2 with its receptor TIE2, their effect on the binding of soluble TIE2 to plate-bound Ang2 was determined by ELISA.

Ang2 (R&D Systems, catalog#623-AN) was coated on a 96-well plate (Thermo Electron, cat#3855) at 200 ng/mL in PBS overnight at 4° C. The plate was then incubated with 100 µl, of blocking solution (Thermo Scientific, cat#N502) for 1 hour at RT. After washing the plate 4 times with 0.1% Tween-20 in PBS, the plate bound Ang2 was incubated with 0.5 µg/mL soluble TIE2 (R&D Systems, cat#313-TI,) in the absence or presence of various concentrations of serially diluted antibodies containing MRDs for 1 hour at RT. After washing 4 times, 100 µL of 0.5 µg/mL anti TIE2 antibody (cat#BAM3313, R&D Systems) was added and incubated at RT for 1 hour. TIE2 binding to Ang2 was detected by incubation with 1:1000 diluted goat anti-mouse-HRP (BD Pharmingen, cat#554002) for 1 hour at RT. The plate was washed 4 times and incubated with 100 µL TMB reagent for 10 minutes at RT. After stopping the reaction with 100 µL of 0.36N $H_2SO_4$, the plate was read at 450 nm using a spectrophotometer.

As presented in FIG. 21A, HER-lm32(H), HER-lm32(L), and AVA-lm32(H) inhibited TIE2 binding to plate-bound Ang2 in a dose-dependent fashion. All tested lm32-containing antibodies demonstrated comparable inhibitory effects with IC-50 values of 4 nM for HER-lm32 (H), 8 nM for HER-lm32(L) and 3.3 nM for AVA-lm32(H).

Example 26. Antibody-MRDs Containing Heavy Chain Fusions Bind to Targets

To determine the specificity and relative affinity of AVA-lm32 (H) binding to VEGF, a competitive binding assay was performed using biotin labeled AVASTIN®.

AVASTIN® was labeled with biotin using EZ-Link NHS-LC-Biotin (Pierce, cat#21336). VEGF (Peprotech, cat#100-20) was coated on a 96-well plate (Thermo Electron, cat#3855) at 100 ng/mL in PBS overnight at 4° C. The plate was then incubated with 100 µL of blocking solution (Thermo Scientific, cat#N502) for 1 hour at RT. After washing the plate 4 times with 0.1% Tween 20 in PBS, 50 µL of AVASTIN®-biotin at 150 ng/mL and 50 µL of various concentrations of AVA-lm32(H) or unlabeled AVASTIN® were added and incubated at RT for 1 hour. The plate was washed 4 times and incubated with Streptavidin-HRP (Thermo, cat#N100) at 1:1000 dilution for 1 hour at RT. The plate was washed 4 times and 100 µL of TMB reagent was added. After 10 minutes incubation at RT, 100 µL of 0.36N $H_2SO_4$ was added to stop the reaction and the plate was read at 450 nm.

The data presented in FIG. 22 demonstrate that AVA-lm32 (H) specifically binds to VEGF-2. It inhibits binding of biotinylated AVASTIN® to VEGF in a dose dependent manner. The dose response curves generated by AVA-lm32 (H) and unlabeled AVASTIN® are superimposable and indicate similar binding affinities.

Example 27. Binding of HER-lm32(H) and HER-lm32(L) to HER2 Expressed on Breast Cancer Cells To determine the relative binding affinity of HERCEPTIN®-based antibodies containing MRDs to cell surface HER2 compared to HERCEPTIN®, a competitive binding assay was performed with Eu-labeled HERCEPTIN®.

HERCEPTIN® was labeled with Eu3+ using a dissociation-enhanced lanthanide fluorescence immunoassay (DELFIA) Europium-labeling kit (Perkin Elmer Life Sciences, cat#1244-302) following the manufacturer's instructions. The labeling agent is the Eu-chelate of N1-(p-isothiocynateobenzyl) diethylenetriamine N1,N2,N3,N3-tetraacetic acid (DTTA). The DTTA group forms a stable complex with Eu3+, and the isothiocynate group reacts with amino groups on the protein at alkaline pH to form a stable, covalent thio-urea bond. HERCEPTIN® (0.2 mg in 200 mL sodium bicarbonate buffer pH 9.3) was labeled with 0.2 mg of labeling agent at 4° C. overnight. Eu-labeled HERCEPTIN® was purified by spin column using 50 mmol/L tris-HCl pH 7.5 and 0.9% NaCl elution buffer.

The Eu-HERCEPTIN® binding assay was performed by incubating 0.5-1 million BT-474 or SK-BR3 breast cancer cells per well in a 96-well plate with 2-5 nM Eu-HERCEPTIN® in the presence of various concentrations of unlabeled HERCEPTIN®-based antibodies containing MRDs or HERCEPTIN® for 1 hour at RT. Unbound Eu-HERCEPTIN® was removed by washing using 200 µL complete medium. Cells were then resuspended in 100 µL complete medium and 80 µL of cell suspension transferred to a 96-well isoplate. Cells were incubated with 100 µL Delfia enhancer solution at RT for 10 minutes and cell bound Eu-HERCEPTIN® was detected by Envison (Perkin Elmer).

The inhibition of binding curves obtained using BT-474 cells are presented in FIG. 23. Eu-HERCEPTIN® binding to BT-474 was inhibited by HERCEPTIN® and HERCEPTIN®-based antibodies containing MRDs in a dose-dependent fashion. Comparable IC-50 values were observed: 4.7 nM for HER-lm32(H), 5.7 nM for HER-lm32(L), and 3.7 nM for unlabeled HERCEPTIN®.

Example 28. Inhibition of Breast Cancer Cells Proliferation by HERCEPTIN®-Based Antibodies Containing MRDs HERCEPTIN sensitive breast cancer cells SK-BR-3 expressing HER2neo receptor were also tested in a bioassay. SK-BR-3 cells (2000 cell/well) were plated in 96 well plates (Costar) in complete McCoy's growth medium containing 2 mM glutamine, pen/strep (Invitrogen) and 10% FBS (Hy-Clone). The cells were cultured for 24 hours at 37° C., 5% $CO_2$, 85% humidity. On the following day, the growth medium was replaced with starvation medium (McCoy's medium containing 2 mM glutamine, pen/strep, 0.5% FBS). Nine serial dilutions (concentration range 5000-7.8 ng/ml) of HERCEPTIN® and HERCEPTIN®-based antibodies containing MRDs were prepared in complete growth medium. After 24 hours of incubation, the starvation medium was removed, and the serial dilutions of HERCEPTIN® and HERCEPTIN®-based antibodies containing MRDs were transferred to the plates in triplicates. The cells were cultured for 6 days. The proliferation was quantified using the CellTiter Glo luminescence method.

The IC50 values determined using a four-parameter logistic model were as follows: 0.49+/−0.17 nm for HER-lm32 (H), 0.81+/−0.19 nm for HER-lm32(L), and 0.67+/−0.15 nm for HER-con4(H). All tested HERCEPTIN®-based antibodies containing MRDs were able to inhibit the proliferation of the SK-BR-3 breast carcinoma cells with subnanomolar IC-50 values. The representative fitted dose response curves shown in FIGS. 24A-C demonstrate that HERCEPTIN®-based antibodies containing MRDs inhibit cell proliferation with similar potency to HERCEPTIN®.

Example 29. Antibody Dependent Cytotoxicity of HERCEPTIN®-Based Antibodies Containing MRDs To assess the ability of antibodies containing MRDs to mediate ADCC in vitro, a cytotoxicity assay based on the "DELFIA EUTDA Cytotoxicity reagents AD0116" kit (PerkinElmer) was used. In this assay, the target cells were labeled with a hydrophobic fluorescence enhancing ligand (BADTA, bis (acetoxymethyl) 2,2':6',2"-terpyridine-6,6"-dicarboxylate). Upon entering the cells, BADTA is converted to a hydrophilic compound (TDA, 2,2':6',2"-terpyridine-6,6"-dicarboxylic acid) by cytoplasmic esterases mediated cleavage and no longer can cross the membrane. After cell lysis, TDA is released into a medium containing Eu3+ solution to form a fluorescent chelate (EuTDA). The fluorescence intensity is directly proportional to the number of lysed cells.

HERCEPTIN® and HERCEPTIN®-based antibodies containing MRDs can mediate ADCC on Her2 positive breast cancer cells by binding to the HER2 receptor on the surface of the target cells and activating the effector cells present in human PBMCs by interacting with their FcγRIII receptors. A HER2 positive human breast cancer cell line SK-BR-3 was used as a target cell line in the ADCC assay to demonstrate this.

SK-BR-3 cells were detached with 0.05% trypsin-versene and resuspended at $1\times10^6$ cells/mL in RPMI1640 medium containing 2 mM glutamine, pen/strep and 10% FBS (complete growth medium). $2\times10^6$ cells in 2 mL of media were transferred into 15 mL tube and 10 µl of BADTA reagent was added. The cell suspension was mixed gently and placed in the incubator at 37° C., 5% $CO_2$ and 85% humidity for 15 minutes. Seven 10× serial dilutions starting with 5 µg/mL of HERCEPTIN® or HERCEPTIN®-based antibodies containing MRDs were prepared during cell labeling.

After incubation with BADTA, cells were washed 4 times in complete growth medium containing 2.5 mM Probenecid. Between washes, cells were spun down by centrifugation at 1000 rpm for 3 minutes. After the last wash, labeled SK-BR-3 cells were resuspended in 10 mL complete growth medium and 50 µl of cells were added to each well of 96 well plate, except background wells. 50 µl of serial dilutions of HERCEPTIN® or HERCEPTIN®-based antibodies containing MRDs were added to the designated wells. The plates were transferred to the incubator at 37° C., 5% $CO_2$ and 85% humidity for 30 minutes.

PBMCs that were purified from human peripheral blood one day prior the ADCC assay, were washed once in RPMI1640 with 2 mM glutamine, pen/strep, 10% FBS. 10 mL of the PBMCs suspension with $2.5\times10^6$ cells/mL was prepared. 100 µl of PBMC suspension was transferred into wells containing target cells and HERCEPTIN® or HERCEPTIN®-based antibodies containing MRDs in triplicate. The following controls were placed in designated wells: Spontaneous release (target cells without effector cells), Maximum release (lysed target cells) and Background (media without cells). The plates were incubated for 2.5 hours an incubator with 37° C., 5% $CO_2$ and 85% humidity.

After incubation 20 µl of the supernatant was transferred to another plate and 200 µl of Europium solution was added. The plates were incubated on a plate shaker at RT for 15 minutes. The time resolved fluorescence was measured using PerkinElmer EnVision 2104 Multilabel Reader.

The following formula was used to calculate percentage of Specific release:

Experimental release (counts)−Spontaneous release (counts)×100 Maximum release (counts)−Spontaneous release (counts)

The IC50 values calculated by a four-parameter logistic model were as follows: 0.213+/−0.077 nM for HER-lm32 (H), 0.204+/−0.036 nM for HER-lm32(L), and 0.067+/−0.015 nM for HER-con4(H). All tested antibodies containing MRDs demonstrated robust ADCC activity with subnanomolar IC-50 values. The representative fitted dose response curves shown in FIGS. 25A and 25B demonstrate that antibodies containing MRDs are able to mediate cell dependent cytotoxicity with comparable potency to HERCEPTIN®.

A similar experiment was conducted in the presence of Ang2. Human PBMCs were activated with 20 ng/ml of IL2 overnight and added to freshly plated (10,000 cells/well) BADTA labeled SK-BR-3 cells. The effector/target ratio was 25/1. After a 4-hour incubation with serial dilutions of HER-lm32(H) or HUMIRA in the presence of 2 µg/ml Ang2, Eu was added to the medium and TRFI measured on Envision reader (Perkin-Elmer). HER-lm32 was more potent in mediating ADCC in the presence of Ang2.

Example 30. Inhibition of Endothelial Cell Proliferation by AVA-lm32(H)

The biological activities of the AVASTIN®-based antibodies containing MRDs AVA-lm32(H) were tested to determine if they could inhibit VEGF-induced proliferation of Human Umbilical Vein Endothelial Cells (HUVEC) assay.

HUVEC were obtained from GlycoTech (Gaithersburg, Md.) and Lonza on passage 1 and passage 3 respectively. Cells were grown on Endothelial cell basal medium (EBM-2) with addition of 2% fetal bovine serum (FBS) and single quotes (Lonza) at 37° C., 5% $CO_2$, 85% humidity. For inhibition of proliferation experiments, cells were plated in 96-well plates (Costar) at 2000 cells per well in EBM-2 medium with 2% FBS and cultivated for 24 hours. Nine serial dilutions of AVASTIN® or AVA-lm32(H) were prepared starting with 5 µg/mL on EBM-2 medium with 2% FBS. VEGF (R & D Systems) was added at a final concentration of 10 ng/mL to all serial dilutions. After incubation for 15 minutes at 37° C., 5% $CO_2$, 85% humidity, serial dilutions were added to the cells. After 96 hours, CellTiter Glo was added to the cells. After incubation at RT for 15 minutes, the cell suspension was transferred into 96 well white opaque plates, and luminescence was measured using PerkinElmer EnVision 2104 Multilabel Reader.

As shown in FIGS. 26A and 26B, AVA-lm32(H) exhibited dose dependent anti-proliferative activity on HUVECs from both sources. IC50 values calculated from 4 PL fitted curves indicate similar potency for AVA-lm32(H) and AVASTIN® (IC50 values 0.36+/−0.42 nM and 0.33+/−0.38 nM, respectively).

Example 31. MRD-Containing Antibodies Inhibit Tumor Proliferation In Vivo

In order to determine the effectiveness of multivalent and multispecific compositions (e.g., MRD-containing antibodies) in vivo, their efficacy in a mouse Colo5 tumor model was assessed. In these experiments, tumors were implanted into the right flank of six-week old female athymic nude mice by injecting $5 \times 10^6$ Colo205 cells suspended in 100 µL PBS. Three groups of eight animals each received intraperitoneal injections of 5 mg/kg of antibody (HERCEPTIN, Rituxan) or an MRD-containing antibody (HER-2×Con4; "H2×Con4") in 100 µL PBS every third day starting at day 6 after tumor implantation. The results, shown in FIG. 27, demonstrate that the MRD-containing antibody was more efficient at inhibiting tumor growth than either Rituximab® or HERCEPTIN®.

HERCEPTIN with lm32 fused to the C-terminus of the heavy chain also inhibited tumor growth in both Her2 dependent and angiogenesis dependent xenograft tumor models. The HERCEPTIN-lm32 fusion had a similar PK to HERCEPTIN in both mice and monkeys after single dose injections. Furthermore, the HERCEPTIN-lm32 fusion was stable in whole blood at 37° C. for up to 72 hours.

Example 32. Molecular Assays to Evaluate MRD-Containing Antibodies

Novel multivalent and multispecific compositions (e.g., MRD-containing antibodies) are generated by altering the sequence of the MRD and/or the antibody, by altering the location at which the antibody is linked to the MRD, and/or by altering the linker through which the MRD is connected to the antibody. The binding potential, structure, and functional properties of the multivalent and multispecific compositions (e.g., MRD-containing antibodies) are evaluated using known techniques to measure protein binding and function. The multivalent and multispecific compositions (e.g., MRD-containing antibodies) are compared to the MRD alone, the antibody alone, and to other multivalent and multispecific compositions (e.g., MRD-containing antibodies).

An MRD-containing antibody is tested using a solid phase assay in which a target of the MRD and/or antibody is immobilized on a solid surface and then exposed to increasing concentrations of a flourescently labeled MRD-containing antibody. The solid surface is washed to remove unbound MRD-containing antibody and the amount of target-bound MRD-containing antibody is determined directly by quantitating fluorescence. In another experiment, the immobilized target is exposed to increasing concentrations of an unlabeled MRD-containing antibody and the amount of target-bound MRD-containing antibody is determined indirectly by use of a labeled reagent that binds to the MRD-containing antibody An MRD-containing antibody is tested using a liquid phase assay in which a target of the MRD and/or antibody is added to various concentrations of an MRD-containing antibody is a solution. The interaction of the target with the MRD-containing antibody is detected by the appearance of a molecular complex comprised of a target and MRD-containing antibody that differs in molecular mass (and mobility) from unbound target and unbound MRD-containing antibody.

An MRD-containing antibody is also assayed in a cell based assay in which target-expressing cells are incubated in the presence of increasing concentrations of MRD-containing antibody. The binding of the MRD-containing antibody is detected by fluorescence activated cell sorting. In addition, cellular proliferation, cellular differentiation, protein phosphorylation, protein expression, mRNA expression, membrane composition, signaling pathway activity, and cellular viability are assessed.

Useful multivalent and multispecific compositions (e.g., MRD-containing antibodies) bind to both the MRD target and to the antibody target. In addition, useful multivalent and multispecific compositions (e.g., MRD-containing antibodies) affect at least one cellular process.

Example 33. Identification of MRDs with Improved Characteristics

Two potential T cell epitopes were identified in LM32. In order to identify LM32 variants that did not contain T cell epitopes, and therefore, were less likely to produce immunogenic responses, mutational and deletional variants of the LM32 peptide were created. The LM32 variants listed in Table 7 MRDs were expressed as MBP fusion proteins and tested for the ability to bind Ang2.

TABLE 7

| MRD expressed as a MBP fusion protein | EC50 (nM) | SEQ ID NO |
|---|---|---|
| KSLSLSPGSGGGSMGAQTNFMPMDNDELLLYEQFI | 1.080 | 32 |
| KSLSLSPGSGGGSMGAQTNFMPMDNEELLLYEQFI | 20.700 | 33 |

TABLE 7-continued

| MRD expressed as a MBP fusion protein | EC50 (nM) | SEQ ID NO |
|---|---|---|
| KSLSLSPGSGGGSMGAQTNFMPMDNDEGLLYEQFILQQGLE | 1.040 | 88 |
| KSLSLSPGSGGGSMGAQTNFMPMDNDELGLYEQFILQQGLE | na | 89 |
| KSLSLSPGSGGGSMGAQTNFMPMDNDEALLYEQFILQQGLE | 0.182 | 90 |
| KSLSLSPGSGGGSMGAQTNFMPMDNDELTLYEQFILQQGLE | 1.420 | 91 |
| KSLSLSPGSGGGSMGAQTNFMPMDNDELLLYEQFIYQQGLE | na | 92 |
| KSLSLSPGSGGGSMGAQTNFMPMDNDEGLLYEQFIYQQGLE | 0.902 | 93 |
| KSLSLSPGSGGGSMGAQTNFMPMDNDEALLYEQFIYQQGLE | 0.392 | 94 |
| KSLSLSPGSGGGSMGAQTNFMPMDNEELTLYEQFIFQQG | na | 95 |
| KSLSLSPGSGGGSMGAQTNFMPMDNDEGLLYEEFILQQGLE | 0.922 | 96 |
| KSLSLSPGSGGGSMGAQTNFMPMDNDEALLYEEFILQQGLE | 0.426 | 97 |
| KSLSLSPGSGGGSMGAQTNFMPMDNEELTLYEEFILQQGLE | na | 98 |
| KSLSLSPGSGGGSMGAQTNFMPMDQDELLLYEQFILQQGLE | 0.383 | 99 |
| KSLSLSPGSGGGSMGAQTNFMPMDDDELLLYEQFILQQGLE | 0.240 | 100 |

The LM32 variants are then tested for their ability to induce proliferation and/or cytokine release. LM32 variants that are functionally active and have reduced immunogenic potential are identified. An MRD-containing antibody comprising the LM32 variant fused to the light chain of HERCEPTIN®, an MRD-containing antibody comprising the LM32 variant fused to the heavy chain of HERCEPTIN®, an MRD-containing antibody comprising the LM32 variant fused to the light chain of HUMIRA®, an MRD-containing antibody comprising the LM32 variant fused to the heavy chain of HUMIRA®, MRD-containing antibody comprising the LM32 variant fused to the light chain of AVASTIN®, and an MRD-containing antibody comprising the LM32 variant fused to the heavy chain of AVASTIN® are created. The LM32-variant containing antibodies are administered to animal models and the plasma protein representation and plasma and tissue residence are measured and compared to those of HERCEPTIN®, HUMIRA®, and AVASTIN®. In addition, the effects of the LM32-variant containing antibodies on cellular proliferation, angiogenesis, tumorigenicity, arthritic indicators are compared to the effects of HERCEPTIN®, HUMIRA®, and AVASTIN®.

Example 34. In Vivo Assays to Evaluate MRD-Containing Antibodies

In order to determine the efficacy of multivalent and multispecific compositions (e.g., MRD-containing antibodies) in vivo, animal models are treated with an antibody and an MRD-containing antibody and the results are compared.

MRD-containing anti-HER2 antibodies are tested in the following in vivo model. NIH 3T3 cells transfected with a HER2 expression plasmid are injected into nu/nu athymic mice subcutaneously at a dose of $10^6$ cells in 0.1 ml of phosphate-buffered saline as described in U.S. Pat. No. 6,399,063, which is herein incorporated by reference in its entirety. On days, 0, 1, 5, and every 4 days thereafter 100 μg of a HER2 antibody, an ang2-containing HER2 antibody, an igf1r-containing HER2 antibody and an ang2-igf1r-containing HER2 antibody are injected intraperitoneally. Tumor occurrence and size are monitored for one month. Increases in efficacy of multivalent and multispecific compositions (e.g., MRD-containing antibodies) compared to antibodies are observed.

MRD-containing anti-VEGF antibodies are tested in the following in vivo model. RIP-TβAg mice are provided with high-sugar chow and 5% sugar water as described in U.S. Published Application No. 2008/0248033, which is herein incorporated by reference in its entirety. At 9-9.5 or 11-12 weeks of age, the mice are treated twice-weekly with intra-peritoneal injections of 5 mg/kg of an anti-VEGF antibody, ang2-containing VEGF antibody, ifg1r-containing VEGF antibody or ang2- and igf1r-containing antibody. The 9-9.5 week mice are treating for 14 days and then examined. The 11-12 week mice are examined after 7, 14, and 21 days of treatment. The pancreas and spleen of the mice are removed and analyzed. Tumor number is determined by dissecting out each spherical tumor and counting. Tumor burden is determined by calculating the sum of the volume of all tumors within the pancreas of a mouse. The effect on angiogenesis is determined by calculating the mean number of angiogenic islets observed. Increases in efficacy of multivalent and multispecific compositions (e.g., MRD-containing antibodies) compared to antibodies are observed.

MRD-containing anti-TNF antibodies are tested in the following in vivo model. Transgenic mice (Tg197) are treated with three intra-peritoneal injections of anti-TNF antibody or ang2-containing TNF antibody at 1.5 μg/g, 15 μg/g, or 30 μg/g as in U.S. Pat. No. 6,258,562, which is incorporated herein by reference in its entirety. Injections continue for about 10 weeks and macroscopic changes in joint morphology are recorded each week. At 10 weeks, mice are sacrificed and microscopic examination of tissue is performed. Joint size is established as an average measurement on the hind right ankle using a micrometer device and arthritic scores are recorded as follows: 1=no arthritis; +/−=mild (joint distortion); ++=moderate arthritis (swelling, joint deformation); and +++=heavy arthritis (ankylosis detected on flexion and severely impaired movement). Histopathological scoring based on haematoxylinleosin staining of joint sections is based as follows; 0=No detectable disease; 1=proliferation of the synovial membrane; 2=heavy synovial thickening 3=cartilage destruction and bone erosion. Increases in efficacy of multivalent and multispecific compositions (e.g., MRD-containing antibodies) compared to antibodies are observed.

Example 35. MRD-Containing Antibodies are Superior to Combinations of Antibodies and MRDs In order to compare the efficacy of multivalent and multispecific compositions (e.g., MRD-containing antibodies) to combinations of antibodies and MRDs, their effect on SK-BR-3 cells treated with EGF was studied.

SK-BR-3 cells were treated with HERCEPTIN, HERCEPTIN containing an EGFR-MRD, HUMIRA containing an EGFR-MRD ("MRD alone"), or HERCEPTIN in combination with HUMIRA containing an EGFR-MRD ("antibody plus MRD alone") for 10 minutes or 3 hours and stimulated with EGF for 5 minutes. Cell lysates were collected and western blots were used to determine phosphotyrosine or phospho-Akt levels. The results are shown in FIG. 28. The HERCEPTIN containing an EGFR-MRD completely inhibited EGF-induced receptor phosphorylation and Akt activation, whereas HERCEPTIN, the MRD alone, and the HERCEPTIN antibody plus MRD alone had little or no effect.

In addition, the effect of multivalent and multispecific compositions (e.g., MRD-containing antibodies) on cellular proliferation was compared to the effect of the combination of antibodies and MRDs. In these experiments, MCF-7 derived breast carcinoma cells were treated with a HERCEPTIN antibody containing an igf1r-targeting MRD fused to the C-terminus of the light chain, HERCEPTIN alone, or a HUMIRA antibody containing the same igf1r-targeting MRD ("MRD alone"). As shown in FIG. 29A, the MRD-containing antibody inhibited cell proliferation better than HERCEPTIN alone or the MRD alone.

MCF-7 cells were also treated with a penta-specific MRD-containing antibody. First, these penta-specific multivalent and multispecific compositions (e.g., MRD-containing antibodies) were shown to bind to five targets. An Ang2-targeting MRD (lm32), and an EGFR-targeting MRD were fused to the N- and C-termini, respectively of a HERCEPTIN antibody. In addition, a $\alpha v\beta 3$-targeting MRD (eeti) and an igf1r-targeting MRD were fused to the N- and C-termini, respectively of the same HERCEPTIN antibody. Ang2, ErbB2, EGFR, IGF1R and $\alpha v\beta 3$ were coated on separate wells of a 96-well plate and incubated with serial dilutions of the MRD-containing antibody. Bound MRD-containing antibody was detected using anti-human IgG-kappa detector. The results demonstrated that the MRD-containing antibody bound to Ang2, ErbB2, EGFR, IGF1R and $\alpha v\beta 3$ with low nanomolar or sub-nanomolar affinities that are comparable to the binding-affinities of the MRDs or antibodies individually.

Then, the ability of these penta-specific multivalent and multispecific compositions (e.g., MRD-containing antibodies) to inhibit proliferation of MCF-7 cells was tested as described above. The results, shown in FIG. 29B, demonstrate that the HERCEPTIN penta-specific multivalent and multispecific compositions (e.g., MRD-containing antibodies) decrease proliferation more efficiently than the HERCEPTIN antibody.

Example 36. MRD-Containing Anti-TNF Antibodies

An MRD-containing antibody that targets TNF was created by fusing an Ang2-binding MRD (lm32) to the C-terminus of HUMIRA heavy chain and was expressed in both transient and stable expression systems. The MRD-containing antibody bound simultaneously to TNF$\alpha$ and Ang2. The MRD-containing antibody bound soluble and cell surface TNF$\alpha$ and retained the binding specificity and Fc functions of HUMIRA (e.g., FcRn, FcgammaR1 and FcgammaR3 binding) and also inhibited Ang2 mediated signaling through Tie-2 receptor in a dose dependent manner with sub-nanomolar affinities.

The HUMIRA-lm32 fusion also inhibited TNF$\alpha$ mediated cytotoxicity in L929 cells. The cells were cultured in 96-well plates overnight and treated with 1 ng/mL TNF plus 1 µg/ml of Actinomycin D in the presence of HUMIRA or HUMIRA-lm32 for 24 hours at 37° C. After incubation, 100 µL of cell Titer-Glow reagent was added, and luminescence was measured using InVision (Perkin-Elmer) after 15 minutes at room temperature. The results demonstrated that HUMIRA and HUMIRA-lm32 displayed equal potency in inhibiting TNF$\alpha$-mediated cytotoxicity in L929 cells (HUMIRA IC50=19.0 ng/ml; HUMIRA-lm32 IC50=18.9 ng/ml).

Furthermore, the HUMIRA-lm32 fusion displayed a dose-dependent protection of hTNF-transgenic mice from clinical signs of arthritis in a well-established mouse model. See, e.g., Keffer et al., EMBO J. 10:4025-4031 (1991). A single-dose PK study in mice demonstrated that the HUMIRA-lm32 fusion and HUMIRA have similar PK and immunogenicity profiles. However, the HUMIRA-lm32 fusion showed increased efficacy in this model compared to that of HUMIRA alone both when measured by clinical symptoms or by histology. See FIG. 30.

Example 37. Zybodies Inhibit EGF-Induced Signaling

SK-BR3 cells were plated at $0.5 \times 10^6$ cells/well in 6-well plates and incubated (37° C., 5% $CO_2$) for 24 hours at which time cells were treated with 10 µg/mL bi- and tri-specific zybodies or Herceptin in 1 mL complete DMEM medium with 10% FBS for 24 hr. at 37° C. Cells were then stimulated with 100 ng/mL EGF for 5 minutes. After stimulation, cells were was disrupted in 200 µL cell lysis buffer (10 mM Tris-HCl (pH 7.5), 1% Triton X-100, 150 mM NaCl, 10% Glycerol, 1 mM sodium vanadate, 5 mM EDTA and protease inhibitors). The cell lysates were centrifuged at 14000 RPM for 10 minutes at 4° C. to remove cell debris. Equal volume of 2× sample buffer and cell lysates were mixed and boiled at 100° C. for 5 minutes, proteins were resolved on a 10% SDS-PAGE and transferred to PVDF (catalog#LC2005, Invitrogen) membranes. Membranes were block with 3% BSA, 0.1% Tween 20 overnight and incubated with antibodies to phospho-AKT (catalog#AF887, R&D systems), phospho-ERK (Catalog#AF1018, R&D systems), and total ERK (MAB1576, R&D system). Horseradish or AP conjugated anti-rabbit and anti-mouse secondary antibodies (Invitrogen) were used to visualize immune-reactive proteins using chemiluminescence or AP detection reagents respectively.

One bispecific antibody used in this example comprised Herceptin and an EGFR-binding MRD (Her-egfr). Another bispecific antibody comprised Herceptin with a Pertuzumab-scfv (which targets a different HER2 epitope than the Herceptin antibody) on the C-terminus of the heavy chain (Her-Pertuzumab(H)). One trispecific antibody comprised Herceptin with an EGFR-binding MRD on the C-terminus of the heavy chain and a Pertuzumab-scfv on the C-terminus of the light chain. Another trispecific antibody comprised Herceptin with an EGFR-binding MRD on the C-terminus of the light chain and a Pertuzumab-scfv on the C-terminus of the heavy chain (Her-zEGFR(L)-Pert(H)). Another trispecific antibody comprised an EGFR-binding MRD, and a Pertuzumab-scfv which targets a different HER2 epitope than the Herceptin antibody (Her-Pert(L)zEGFR(H) and Her-zEGFR(L)-Pert(H).

SK-BR3 cells express very high levels of HER2 and are sensitive to anti-proliferative effects of Herceptin. Inhibition of constitutively activated AKT is one of the mechanisms for the anti-proliferative effects of Herceptin in HER2 over-expressing cells. Such inhibition can be overcome by the addition of growth factors such as EGF, IGF-1 and Heregulin (HRG) through the induction of intracellular pro-mitogenic signaling. As shown in FIG. 31, EGF-induced activation of AKT and ERK pathways in SK-BR3 cells as shown by increase in phosphorylated AKT and ERK levels. Herceptin had no effect on EGF-induced activation of signaling pathways in SK-BR3 cells whereas Her-egfr and the two tri-specific zybodies with an EGFR targeting peptide inhibited EGF effects. Compared to the bi-specific antibody which inhibited only EGF-induced signaling, tri-specific antibodies also inhibited constitutively active levels of Akt and ERK in SK-BR3 cells.

Example 38. Zybodies Inhibit Heregulin-Induced Signaling

SK-BR3 cells were plated at $0.5 \times 10^6$ cells/well in 6-well plates and cultured overnight. The next day, cells were treated with 10 µg/mL bi- and tri-specific zybodies or Herceptin in 1 mL complete DMEM medium with 10% FBS for 24 hr. at 37° C. Cells were then stimulated with 200 ng/mL Heregulin for 10 minutes. Western blot analysis was performed to detect phosphorylated and total Aid and ERK levels as described in Example 37.

Heregulin binds to HER3 and induces activation of signaling pathways via HER2-HER3 heterodimer formation. As shown in FIG. 32, Heregulin induced activation of Akt and ERK in SK-BR3 cells. Herceptin and HER-egfr had no effect on Heregulin-induced Akt activation. Pertuzumab, but not Herceptin, blocks Heregulin mediated HER2-HER3 heterodimer formation and signaling. FIG. 32 shows that bi- and tri-specific zybodies comprising a Pertuzumab-scfv completely inhibited Heregulin-induced Akt activation in SK-BR3 cells.

Example 39. Zybodies Inhibit EGF- and Heregulin-Induced Signaling

SK-BR3 cells were plated at $0.5 \times 10^6$ cells/well in 6-well plates and cultured overnight. The next day, cells were treated with 10 µg/mL bi and tri-specific zybodies or Herceptin in 1 mL complete DMEM medium with 10% FBS for 24 hr. at 37° C. Cells were then stimulated with 100 ng/mL EGF and 200 ng/mL Heregulin for 10 minutes. Western blot analysis was performed to detect phosphorylated and total Akt and ERK levels as described in Example 37.

Combined stimulation of SK-BR3 cells with EGF and Heregulin resulted in both AKT and ERK activation (FIG. 33). Herceptin, HER-efgr and HER-pertuzuScfv were ineffective in blocking the combined effects of EGF and Heregulin. Tri-specific zybodies that contained both an EGFR targeting peptide and a Pertuzumab-scfv completely inhibited EGF and Heregulin induced Akt and ERK activation in SK-BR3 cells.

Example 40. Zybodies Down-Regulate Cell-Surface EGFR

SK-BR3 cells were plated at $0.5 \times 10^6$ cells/well in 6-well plates and cultured overnight. The next day, cells were treated with 10 µg/mL bi- and tri-specific zybodies, Herceptin, Erbitux, EGF, and combinations thereof in 1 mL complete DMEM medium with 10% FBS for 24 hr. at 37° C. as indicated. Cells were detached and the levels of EGFR on the cells were determined by Flow cytometry using PE conjugated anti-EGFR antibody.

The zybodies used in this experiment were a Herceptin antibody with an EGFR-binding MRD on the C-terminal of the heavy chain (HER-egfr(H)); a Humira antibody with an EGFR-binding MRD on the C-terminal of the heavy chain (HUM-egfr(H)); Herceptin with a Pertuzumab-scfv on the C-terminal of the heavy chain (HER-perscfv(H)); Humira with a Pertuzumab-scfv on the C-terminal of the heavy chain (HUM-perscfv(H)); Herceptin with a Pertuzumab-scfv on the C-terminal of the light chain and an EGFR-binding MRD on the C-terminal of the heavy chain (HER-perscfv (L)-egfr(H)); Herceptin with a Pertuzumab-scfv on the C-terminal of the heavy chain and an EGFR-binding MRD on the C-terminal of the light chain (HER-perscfv(H)-egfr (L)); and a Humira antibody with an EGFR-binding MRD (HUM-egfr).

Erbitux, EGF, and bi- and tri-specific zybodies containing egfr-targeting peptides down regulated EGFR receptor levels on the cell surface. FIGS. 34A and B. Treatment with HER-egfr for 24 hr. was more effective (61%) than HUM-egfr alone (27%) or in combination of HUM-egfr plus Herceptin (41%) and Erbitux plus Herceptin (51%) (FIGS. 34A and B). This indicates that simultaneous targeting of EGFR and HER2 in zybody format was more effective in down regulating EGFR than a combination of two individual antibodies. Also, treatment with tri-specific antibodies that target EGFR and two different epitopes of HER2 completely down regulated (99%) EGFR levels on SK-BR3 cells.

Example 41. Zybodies Down-Regulate EGFR Expression

SK-BR3 cells were plated at $0.5 \times 10^6$ cells/well in 6-well plates and cultured overnight. The next day, cells were treated with 10 µg/mL bi and tri-specific zybodies or Herceptin in 1 mL complete DMEM medium with 10% FBS for 24 hr. at 37° C. Cell lysates were prepared and Western blot analysis was performed to detect EGFR using EGFR antibody (catalog# MAB10951, R&D system) and total ERK levels as described in Example 37.

Treatment with Herceptin and Her-Pertuzumab scfv had no effect on EGFR levels in SK-BR3 cells. HER-egfr partially down regulated EGFR protein and almost complete degradation of EGFR was observed in cells treated with tri-specific zybodies.

Example 42. Zybodies Increase MRD Potency

The following experiments were performed to examine the effect that antibody fusion has on MRD potency. Individual wells of a 96-well plate were coated with IGF1R and ErbB2-Fc (HER2) (1 ug/ml) at varying ratios. Wells were washed, and then serial dilutions of zybodies were added in the presence of biotin-labeled IGF-1. The zybodies used were a Herceptin antibody containing an IGFR-targeting MRD on the C-terminus of the heavy chain (HER-igfr(H)) and a Humira antibody containing an IGFR-targeting MRD on the C-terminus of the heavy chain (HUM-igfr(H)). Bound IGF-1 was quantitated by addition of streptavidin-HRP. The results are shown in the table below.

TABLE 8

Inhibition of IGF-1 Binding, $IC_{50}$ (nM)

| Zybody | Ratio of IGF1R:HER2 | | | |
|---|---|---|---|---|
| | 1:0 | 3:1 | 1:1 | 1:3 |
| HER-igfr(H) | 220 | 20.91 | 1.44 | 0.14 |
| HUM-igfr(H) | 240 | 189.9 | 186 | 111 |

The inhibition of IGF-1 binding was similar for both zybodies tested when the plates did not contain ErbB2-Fc (HER2) (IC50 HER-igfr(H)=220 nM; IC50 HUM-igfr(H)=240 nM). When the plates contained both the antibody target and the MRD target, binding to MRD target drastically decreased. For example, using the HER-igfr(H) zybody, inhibition of IGF-1 binding dropped from $IC_{50}$=220 nm when the antibody target was not on the plates (ratio of IGFR1R:HER2=1:0) to IC$_{50}$=1.44 when the antibody target and MRD target were present on the plates in equivalent amounts (ratio of IGFR1R:HER2=1:1). The data indicate that engagement of both antibody and MRD targets by HER-igf1r(H) enhances the potency of the low affinity IGF-1R MRD>1000-fold. In contrast, this drastic effect was not observed when the same experiment was performed using a zybody containing the Humira antibody, which does not bind to HER2 even though the zybody contained the same IGF1R-targeting MRD. Thus, bi-specific zybodies display enhanced MRD potency through heterotypic avidity-driven binding.

Example 43. Conformational Constraints can Increase MRD Binding and Stability In order to determine the effect of conformational constraints on MRDs in the context of an MRD-containing antibody, several modified MRD constructs containing cysteines at various locations were developed. The cysteines form intermolecular disulfide bonds and therefore contain the three-dimensional conformation of the proteins. The MRD that was altered in this experiment was MPM. The sequence of MPM, which is shown in the table below, is similar to the sequence of lm32 (described above), but contains four amino acid changes: MSG, N16Q, L19A, and Q24E. The G at position five in MPM minimizes potential oxidation of the methionine residue, and L19A and Q24E remove potentially immunogenic sequences. In these experiments, all MRDs were fused to the C-terminus of the Herceptin heavy chain.

The resulting multivalent and multispecific compositions (e.g., MRD-containing antibodies) were then tested for target binding and stability. Stability was determined by administering the MRD-containing antibody by IV injection to mice and comparing the levels of MRD in the plasma 15 minutes post-injection to the levels of MRD in the plasma 2, 3, or 4 days post-injection. The results are shown below in Table 9.

TABLE 9

Binding and Stability of Constrained MRDs

| Construct | Sequence | EC50 nm | MRD % 48 hrs |
|---|---|---|---|
| HER-2x-con4 | AQQEECEWDPWTCEHMGSGSATGGS GSTASSGSGSATHQEECEWDPWTCEH MLE (SEQ ID NO: 136) | 0.018 | 70 |
| HER-lm32(H) | KSLSLSPGKGGGSMGAQTNFMPMDND ELLLYEQFILQQGLE (SEQ ID NO: 34) | 0.033 | 23 |
| HER-mpm(H) | KSLSLSPGSGGGSGGAQTNFMPMDQD EALLYEEFILQQGLE (SEQ ID NO: 56) |  | 19 |
| HER-lm32 (MPM Q8C G30C) (H) | KSLSLSPGSGGGSGGACTNFMPMDQD EALLYEEFILQQCLE (SEQ ID NO: 57) | 4.06 |  |
| HER-lm32 (MPM T9C G30C) (H) | KSLSLSPGSGGGSGGAQCNFMPMDQD EALLYEEFILQQCLE (SEQ ID NO: 58) | 0.598 | 38 |
| HER-lm32 (MPM N10C G30C) (H) | KSLSLSPGSGGGSGGAQTCFMPMDQD EALLYEEFILQQCLE (SEQ ID NO: 67) | 0.177 | 9 |
| HER-lm32 (MPM F11C G30C) (H) | KSLSLSPGSGGGSGGAQTNCMPMDQD EALLYEEFILQQCLE (SEQ ID NO: 68) | 5.91 |  |
| HER-lm32 (MPM N10C L28C) (H) | KSLSLSPGSGGGSGGAQTCFMPMDQD EALLYEEFICQQGLE (SEQ ID NO: 69) | 0.403 | 33 |
| HER-lm32 (MPM M5C G30C) (H) | KSLSLSPGSGGGSCGAQTNFMPMDQD EALLYEEFILQQCLE (SEQ ID NO: 70) | 0.0641 | 60 |
| HER-lm32 (MPM M5C L28C) (H) | KSLSLSPGSGGGSCGAQTNFMPMDQD EALLYEEFICQQGLE (SEQ ID NO: 101) | 0.109 | 14 |
| HER-lm32 MPM A7C G30C) (H) | KSLSLSPGSGGGSGGCQTNFMPMDQD EALLYEEFILQQCLE (SEQ ID NO: 108) | 0.174 | 82 |
| HER-lm32 (MPM P13C G30C) (H) | KSLSLSPGSGGGSGGAQTNFMCMDQD EALLYEEFILQQCLE (SEQ ID NO: 109) |  |  |
| HER-lm32 (MPM M5C N10C) (H) | KSLSLSPGSGGGSCGAQTCFMPMDQD EALLYEEFILQQGLE (SEQ ID NO: 110) | 0.2 | 13 |
| HER-lm32 (MPM M5C F11C) (H) | KSLSLSPGSGGGSCGAQTNCMPMDQD EALLYEEFILQQGLE (SEQ ID NO: 111) |  |  |
| HER-lm32 (MPM D5 N10C G30C) (H) | KSLSLSPGSGGGSCFMPMDQDEALLYE EFILQQCLE (SEQ ID NO: 112) | 0.751 | 3 |
| HER-lm32 (MPM D5 N10C L28C) (H) | KSLSLSPGSGGGSCFMPMDQDEALLYE EFICQQGLE (SEQ ID NO: 113) | 0.697 | 36 |

The results demonstrated that adding two cysteine residues outside the core target-binding domain (e.g., PMDQDEALLY in MPM) of an MRD can increase the MRD half-life without substantially decreasing the binding affinity.

Constructs containing one cysteine located near the terminus of the molecule (e.g., about two amino acids away from the terminus) and one cysteine located on the opposite end of the target-binding domain (e.g., at least about 3 or about 4-7 amino acids outside of the core binding domain) and near the protein fusion (e.g., about 4-6 amino acids away from the linker or antibody sequence) can show increased MRD half-life without substantially decreasing the binding affinity. Furthermore, MRDs that include cysteines within the target-binding site, in particular on either end of the target-binding site can be MRDs that have both high stability and efficient target binding.

Novel multivalent and multispecific compositions (e.g., MRD-containing antibodies) in which the MRDs have a long half-life in vivo and efficient target-binding can be identified by altering the sequence of the MRD to include at least two cysteines. The cysteines can be at least about 6, about 7, about 8, about 9, about 10, about 11, about 12, about 13, about 14, about 15, about 16, about 17, about 18, about 19, or about 20 amino acids away from each other. The binding potential and half-life of the MRD in the MRD-containing antibody is evaluated using known techniques and the methods described herein. MRD-containing antibodies are administered to mice intravenously. Plasma is collected from mice shortly after administration (e.g., 15 minutes after administration) and at a later time point (e.g., 2, 3, or 4 days after administration). Useful multivalent and multispecific compositions (e.g., MRD-containing antibodies) that both bind efficiently to the MRD target and are stable in vivo (e.g., at least about 50% of the MRD is present 48 hours after administration) are identified.

Example 44. MRD-Containing Antibodies for Redirected T-Cell Killing

Antibody MRD-fusion molecules were prepared by fusion of a CD3-targeting peptide to an anti-CD19 antibody and by fusion of a CD19-targeting peptide to an anti-CD3 antibody. The resulting MRD-containing antibodies are analyzed by flow cytometric analysis on CD3-positive Jurkat cells, human PBMCs and a number of different CD19-positive B cell lymphoma cell lines (e.g., SKW6.4, Blin I, BJAB, Daudi and Raji) to determine their specific binding affinities to each target. Since BL60 and the plasmacytoma cell lines NCI and L363 are negative for both CD3 and CD19, they are used as negative control cells to determine the specificity MRD-containing antibodies. CD3-negative Jurkat cells can also be used as a negative control cell population. Cell lines are cultured in complete RPMI 1640 (Invitrogen) with 10% FCS (GIBCO).

Cells are washed with PBS and blocked by resuspension in PBS with 10% human IgG (Innovative Research) and 0.1% $NaN_1$ (blocking buffer) for 30 min at 4° C. Cells are then pelleted by centrifugation (100×g for 5 min) followed by incubation with the MRD-containing antibodies in blocking buffer for 30 min at 4° C. The cells are washed three times with PBS, and cell-surface bound MRD-containing antibodies are detected. Flow cytometry can be performed with a BD FACScan.

Example 45. In Vitro Cytotoxicity of MRD-Containing Antibodies for Redirected T-Cell Killing The bispecific CD19/CD3 MRD-containing antibodies are assayed with respect to their abilities to induce redirected T-cell killing of CD19-positive lymphoma cells. Human peripheral blood mononuclear cells (PBMCs) are isolated as effector cells from fresh buffy coats of random donors using Lymphoprep™ (Nycomed/Axis-Shield PoC) gradient centrifugation with subsequent centrifugation at 100×g to remove platelets. CD19-positive B cells are depleted using Dynabeads® CD19 Pan B (Life Technologies). The PBMC populations are analyzed by flow cytometry before and after CD19-positive B cell depletion by labeling with FITC-conjugated mouse antibody against human CD19 and counter-labeled with a PE-conjugated anti-CD45 antibody. The PBMCs are incubated overnight at 37° C. under 5% $CO_2$. CD19-positive B cell lines (e.g., SKW6.4, Blin I, BJAB, Daudi and Raji) were used as target cells.

Target cells are incubated in 96-well plates using RPMI 1640 complete medium (Invitrogen) with 10% FCS (GIBCO) at different densities, such that addition of the same number of unstimulated PBMCs resulted in different effector-to-target cell (E:T) ratios. Various concentrations of bispecific CD19/CD3 MRD-containing antibodies are then added to each well followed by the addition of unstimulated PBMCs. Plates are incubated at 37° C. under 5% $CO_2$ for 3 hrs. Cytotoxicity can be measured using the DELFIA® EuTDA cytotoxicity assay (PerkinElmer) in round-bottom 96-well-plates following manufacturer's instructions. Spontaneous cell death is measured by incubating the target cells without effector cells or MRD-containing antibodies, and maximal cell death is determined by incubating the target cells with 10% Triton X-100. The fraction of specific cell lysis is calculated as the ratio between effector mediated cytotoxicity ([experimental cell death]−[spontaneous cell death]) and the maximum expected cytotoxicity ([maximal cell death]−[spontaneous cell death]).

Example 45. In Viva Efficacy of MRD-Containing Antibodies for Redirected T-Cell Killing Raji B lymphoma cells are removed from routine cell culture, washed in PBS, and prepared as $1\times10^7$ cells/ml. NOD/SCID mice are then inoculated subcutaneously with $1\times10^6$ Raji cells with or without $5\times10^6$ PBMCs (as prepared above) in a 50% Matrigel solution. Bispecific CD19/CD3 MRD-containing antibodies are administered intravenously 1 hr after lymphoma cell inoculation. As negative controls, bispecific MRD-containing antibodies directed to HER2 and CD3 (i.e., a CD3-binding MRD fused to an anti-HER2 antibody and a HER2-binding MRD fused to an anti-CD3 antibody) and HER2 and CD19 (i.e., a CD19-binding MRD fused to an anti-HER2 antibody and a HER2-binding MRD fused to an anti-CD19 antibody) and PBS are also administered intravenously 1 hr after lymphoma cell inoculation. MRD-containing antibodies or PBS are administered once per day for four days after the initial dose. Subcutaneous tumors are measured by caliper to determine growth rate for each treatment group. Body weight of mice is also determined twice per week as an indicator of treatment tolerability.

Example 46. Zybodies Displaying DR5 Agonizing MRDs on Distinct mAb Scaffolds

The cytotoxic effects of several zybodies (i.e., MRD-containing antibodies) expressing different valencies of a DR5 (TNFRSF10B/TRAILR2) agonizing MRD were assessed on three different mAb scaffolds using a cell viability assay. Briefly, eight serial dilutions of Zybodies (5-fold, starting at 30 mg/mL) were incubated with $10^4$ COLO-205 cells in 96-well plate wells, containing 100 ml of RPMI medium supplemented with 10% FBS. After 48 hrs cell viability was measured by Cell TiterGlo® (Promega). The results depicted in FIG. 36A, demonstrate that a tetravalent 2×dr51m(H)-TRA zybody, containing four copies of the DR5 MRD fused to the trastuzumab mAb scaffold, demonstrated higher cytotoxic activity compared to bivalent Zybodies dr51m(H)-TRA, dr51m(L)-TRA and TRA-dr51m (H). These results demonstrate that increased valency of the DR5 agonistic MRDs correlates with increased cell killing through the DR5 death-domain receptor.

To further investigate the role of valency on DR5-mediated cell cytotoxicity, two octa-valent zybodies (2×dr51m (L)2×dr51m(H)-HER and 2×dr51m(L)2×dr51m(H)-PAL comprising a trastuzumab and palivizumab mAb scaffold, respectively) were assayed for their ability to kill COLO205 tumor cells compared to a similarly constructed tetra-valent zybody of the same specificities.

Figure 36A:
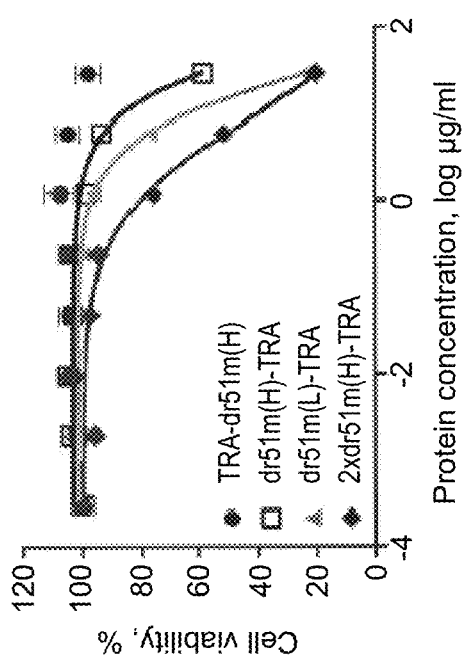
Figure 36B:
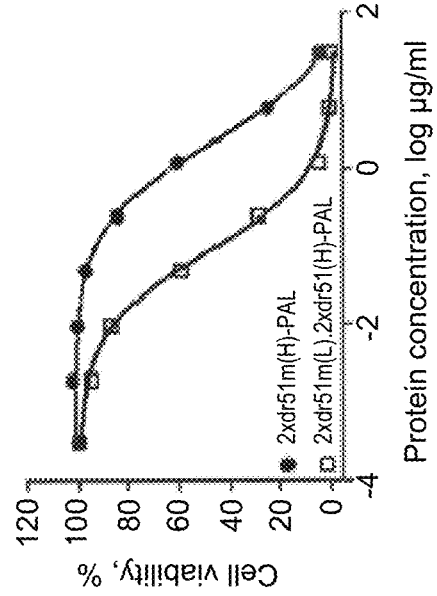
Figure 36C:
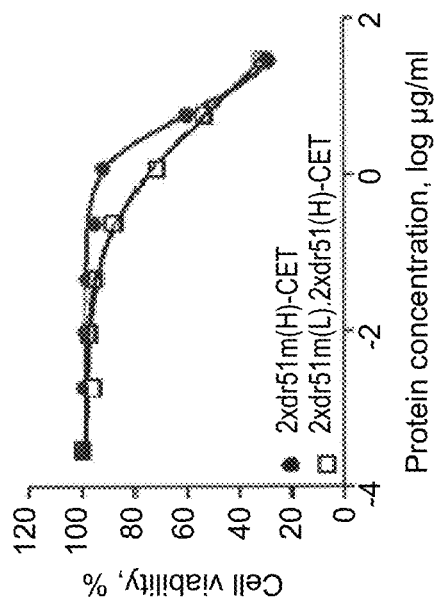

The octavalent zybodies 2×dr51m(L)2×dr51m(H)-HER and 2×dr51m(L)2×dr51 m(H)-PAL, containing eight copies of the DR5 MRD, demonstrated higher cytotoxic activity compared to tetravalent zybodies 2×dr51m(H)-HER and 2×dr51m(H)-PAL (FIGS. 36B-C). These results further establish the correlation between increase DR5-binding valency and increased cytotoxic activity (i.e., cell death).

Figure 36D:
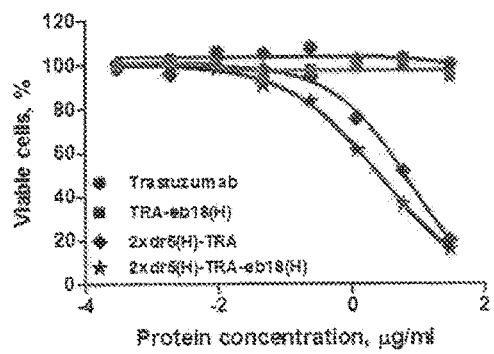

To explore the effect of additional non-DR5 binding specificities on the cytotoxicity of DR5-based zybodies, the Her2-targeting MRD (eb18) was fused to the C-terminus of the heavy chain of trastuzumab to yield a tri-specific, tetra-valent DR5 zybody, 2×DR5(H)-TRA-eb18(H). The eb18 MRD was chosen because it binds her2 through an epitope that is distinct from that recognized by trastuzumab. The multi-epitopic targeting of her2 enhanced the cytotoxicity of the zybody (FIG. 36D). These results demonstrate that a zybody capable of multi-epitopic targeting of non-DR5 receptors (her2) enhances the cytotoxic activity of a tetra-valent DR5 targeting MRDs.

Figure 36E:
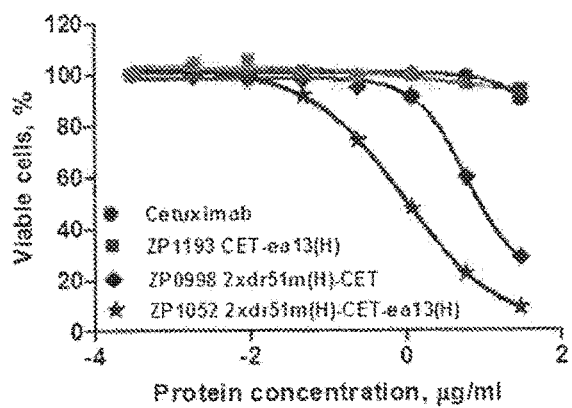

To further explore the effect of multi-specificity on the cytotoxic activity of DR5-based zybodies, the EGFR-targeting MRD (eb13) was fused to the C-terminus of the heavy chain of cetuximab (anti-EGFR) to yield a tri-specific, tetra-valent DR5 zybody, 2×DR5(H)-CET-eb13(H). The eb13 MRD was chosen because it binds EGFR through an epitope that is distinct from that recognized by cetuximab. The multi-epitopic targeting of EGFR enhanced the cytotoxicity of the zybody (FIG. 36E). These results demonstrate that a zybody capable of multi-epitopic targeting of non-DR5 receptors (EGFR) enhances the cytotoxic activity of a tetra-valent DR5 targeting MRDs.

Figure 36F:
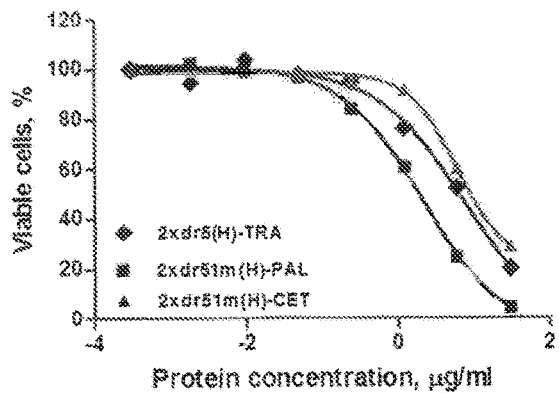

To investigate the effect of mAB scaffold specificity on the activity of DR5-based zybodies, the cytotoxic potency of three zybodies was compared where each zybody was constructed with the same DR5-targeting MRDs on a different scaffold; cetuximab (CET), trastuzumab (TRA), and palivizumab (PAL). The results demonstrate that the mab scaffold of the zybody can influence the apparent cytotoxic potency of DR5 targeting MRDs (FIG. 36F).

Example 47. Specificity of Ang-Binding MRDs to Ang1, Ang2, and Ang4

The specificity of a select group of Ang2-binding peptides displayed on phage for Ang1, Ang2 and Ang4 was assessed in a direct binding ELISA. Briefly, ELISA plates were coated with the indicated protein at 0.1 ug/ml in PBS. Plates were blocked and phage supernatants added at a dilution of 1:10 in blocking buffer. Unbound phage were removed by washing with PBS 0.1% Tween and bound phage detected using an HRP conjugated anti-M13 monoclonal antibody. The assayed peptides were as follows: ANG100 (SEQ ID NO:621), ANG126 (SEQ ID NO:232); ANG129 (SEQ ID NO:234); ANG156 (SEQ ID NO:255); ANG157 (SEQ ID NO:256); ANG163 (SEQ ID NO:261); ANG179 (SEQ ID NO:270); ANG200 (SEQ ID NO:628); ANG303 (SEQ ID NO:331); ANG318 (SEQ ID NO:625); ANG335 (SEQ ID NO:332); and ANG599 (SEQ ID NO:367).

The data demonstrate that all Ang-binding peptides bind Ang2 but they differ in the relative binding to Ang1 and Ang4 (FIG. 37). These data demonstrate that the fine specificity of Ang binding peptides can differ from one peptide to another. The cross-reactivity of MRDs with members of the Ang family can be exploited in diseases characterized by differential Ang-family member expression.

Example 48. Identification of Exemplary Target Binding MRDs

The following exemplary target-binding MRDs were identified using procedures essentially as descried herein.

TABLE 10

ANG2 binding MRDs

| SEQ ID: | Ref. No. | Peptide Sequence |
|---|---|---|
| 136 | ANG2 | SACDHPMNNKCG |
| 137 | ANG4 | SACGTFTHPQCG |
| 138 | ANG6 | SACHPMAPKSCG |
| 139 | ANG7 | SACGSYNHPMCG |
| 140 | ANG8 | SACGSYEHPMCG |
| 141 | ANG10 | SACQSSVCFFVRWRF |
| 142 | ANG12 | SACHPLIHNRCG |
| 143 | ANG18 | TCIFNFPACI |
| 144 | ANG19 | FCDEYTPAWCW |
| 145 | ANG20 | MCPDFGMFIYCI |
| 146 | ANG22 | QCQEVISACFGQAGQGGGSGGS QCWLMELVCL |
| 147 | ANG23 | KCPDMWPQCW |
| 148 | ANG24 | KCPDMWPMCW |
| 149 | ANG25 | QCEWIWVACDGQAGPAGFCYE HMLMCA |
| 150 | ANG26 | RCYEVWWDCA |
| 151 | ANG27 | ACIPDLFLCM |
| 152 | ANG28 | QCMWMWYQCR |
| 153 | ANG29 | KCPDMWPECW |
| 154 | ANG30 | PCQYWWVLCP |
| 155 | ANG31 | LCWNHWWMCE |

TABLE 10-continued

ANG2 binding MRDs

| SEQ ID: | Ref. No. | Peptide Sequence |
|---|---|---|
| 156 | ANG32 | FCHEYTPACCW |
| 157 | ANG33 | KCPDFWPECW |
| 158 | ANG34 | ECYHHWPECM |
| 159 | ANG35 | RCPDMWFPACW |
| 160 | ANG37 | ICIYWKDPWCY |
| 161 | ANG38 | KCPDLWPQCY |
| 162 | ANG40 | YCWVIAKSCVGQAGQGGGGG SICRHYVWRCE |
| 163 | ANG41 | LCWNHWWMCD |
| 164 | ANG42 | MCTWQFMVCPGQAGQGGGSG GSYCWEYVYRCD |
| 165 | ANG43 | MCWNHWWMCE |
| 166 | ANG46 | HCIFNFPACI |
| 167 | ANG47 | LCFNHWWMCP |
| 168 | ANG49 | MCIYWKEPWCY |
| 169 | ANG50 | WCDHTEAWPECF |
| 170 | ANG51 | ECYWYPNPMWCY |
| 171 | ANG52 | HCPWGTTMNCV |
| 172 | ANG54 | ECTDYPEWRYCQ |
| 173 | ANG55 | ECFFFPNPWHCY |
| 174 | ANG56 | PCAWFPNPSFCY |
| 175 | ANG58 | MCPWWYDHLHCY |
| 176 | ANG59 | MCPIWYDHQWCH |
| 177 | ANG61 | ECWWYYNHFWCH |
| 178 | ANG62 | ECAWFPNPWCCY |
| 179 | ANG63 | GCWHDGFMCF |
| 180 | ANG64 | WCDHWIVWPECW |
| 181 | ANG65 | QCNDYPNWRYCF |
| 182 | ANG66 | PCAWYPNPEFCY |
| 183 | ANG67 | LQYEEFYDHV |
| 184 | ANG68 | QCPYRINHQRCS |
| 185 | ANG69 | DCVWFPNPDWCY |
| 186 | ANG70 | FCALFPYMFPCE |
| 187 | ANG71 | DGSPCAWFPNPSFCY |
| 188 | ANG72 | VCPWWYDHWLCS |
| 189 | ANG73 | ECDGWEYHYFCW |
| 190 | ANG74 | YCPLCQYHYGCF |
| 191 | ANG75 | SCWWYPNPQWCY |
| 192 | ANG76 | ECYFLVNMEWCQ |
| 193 | ANG77 | TCWFWELEFFCI |
| 194 | ANG78 | KCYWFPNPIECY |
| 195 | ANG79 | DCAWFPNPAWCH |
| 196 | ANG80 | HCPYWYDHELCH |
| 197 | ANG81 | YCPQWYDHWLCT |
| 198 | ANG82 | NCWEYPNPAWCY |
| 199 | ANG83 | ECDGWEYHYVCW |
| 200 | ANG84 | ECYWYPNPWFCY |
| 201 | ANG85 | DCVDYPGWEYCV |
| 202 | ANG86 | ECYMLHACYDEGH |
| 203 | ANG87 | WCDRGTYVMFCD |
| 204 | ANG88 | TCPVWWDDYWCG |
| 205 | ANG89 | WCDYGTYVVQCE |
| 206 | ANG90 | HCYWHPSPSWCY |
| 207 | ANG91 | QCYWFPNPLECY |
| 208 | ANG93 | QCKWFPNPKECY |
| 209 | ANG94 | PCPYYFNRQHCV |
| 210 | ANG95 | ICYVYGLEEWCI |
| 211 | ANG98 | HCPLWYDHYFCA |
| 212 | ANG101 | ACAWYPNPVECY |
| 213 | ANG102 | ECAIYPNPQWCY |
| 214 | ANG103 | DCYYYPNPSWCW |
| 215 | ANG104 | DCYYPNPQWCF |
| 216 | ANG106 | QCPWWYDHYWCN |
| 217 | ANG107 | FCDFYDYHYVCF |
| 218 | ANG108 | VCPYWWDHWLCL |
| 219 | ANG109 | MCPFWYDHELCV |
| 220 | ANG110 | ICPWWYDHYTCF |
| 221 | ANG111 | ACDWFQNPYVCW |
| 222 | ANG112 | PCAWYPNPAECY |
| 223 | ANG113 | ECPFWYDHYMCM |
| 224 | ANG114 | PCHWFPNPTECY |
| 225 | ANG116 | ECYTFPNPQFCY |
| 226 | ANG118 | SCYSYPNPAWCY |
| 227 | ANG119 | ECYWYPNPHWCR |
| 228 | ANG120 | IICYWIIPSPNWCR |
| 229 | ANG121 | HCPDWYNHQLCP |
| 230 | ANG122 | ACVWFPNPDWCY |

TABLE 10-continued

ANG2 binding MRDs

| SEQ ID: | Ref. No. | Peptide Sequence |
|---|---|---|
| 231 | ANG123 | LGPVLLECYFYPNPQHCY |
| 232 | ANG126 | VPIDCYFYPNPPECYLHN |
| 233 | ANG128 | GYRDCYFYPNPRHCYGSH |
| 234 | ANG129 | VVVEFWECYVYPNPPHCY |
| 235 | ANG130 | LVNDCFFFPNPPHCYVSS |
| 236 | ANG131 | RMADCYFYPNPQHCYTEG |
| 237 | ANG132 | DEQACYFYPNPAHCYQRD |
| 238 | ANG133 | FLGAMMDCYFFPNPPHCY |
| 239 | ANG134 | VYQDCYNFPNPVIICYRTT |
| 240 | ANG135 | LVDYSMDCYFFPNPPHCY |
| 241 | ANG136 | HSLIYHDCYFYPNPPHCY |
| 242 | ANG137 | LLSVLLECYFYPNPPHCY |
| 243 | ANG138 | PTDVLLECYLYPNPPHCY |
| 244 | ANG139 | SLPLRAFCYFPPNWPHCY |
| 245 | ANG142 | TDTDCYFFPNPPHCYSPG |
| 246 | ANG143 | IYDDCYIFPNPHHCYVGF |
| 247 | ANG144 | PWHECYWYPNPPHCYGIL |
| 248 | ANG145 | MPLIFSECYSYPNPPHCY |
| 249 | ANG148 | GNFAHEECYFYPNPAHCY |
| 250 | ANG149 | QPRLLHDCYFYPNPSHCY |
| 251 | ANG150 | NPTDCYFYPNPQHCYNWG |
| 252 | ANG151 | YPFFLVDCYFFPNPLHCY |
| 253 | ANG153 | SVAHVHGLLLLPESDALL |
| 254 | ANG154 | GEYDCYFYPNPPHCYDRN |
| 255 | ANG156 | LHVDCYFYPNPPHCYIDE |
| 256 | ANG157 | QDHDCYFYPNPPHCYLEG |
| 257 | ANG158 | HFSDCFFYPNPQHCYHMM |
| 258 | ANG159 | PIEDCYFYPNPRHCYLQP |
| 259 | ANG160 | ECCYCYNYDTWSHCCQKG |
| 260 | ANG161 | VVLPSYDCYFYPNPPIICY |
| 261 | ANG163 | VPWDCYFYPNPPHCYEDA |
| 262 | ANG164 | FVSSAFDCYFYPNPAHCY |
| 263 | ANG165 | ALVECYFYPNPLHCYNTS |
| 264 | ANG166 | FWYSLDDCYFYPNPSHCY |
| 265 | ANG169 | RSNLMTDCYYYPNPPHCY |
| 266 | ANG172 | QLVDCLYYPNPPHCYESM |
| 267 | ANG174 | WDVDCGFFPNPAYCYELG |
| 268 | ANG175 | LQGRMIDCYSYPNPPHCY |
| 269 | ANG176 | QRDPLAACYIYPNPPHCY |
| 270 | ANG179 | ELWECYFYPNPSHCYTDR |
| 271 | ANG180 | QDIDCYFYPNPPHCYHVT |
| 272 | ANG182 | RLHDCYFYPNPPHCYLWQ |
| 273 | ANG183 | SLTTFTDCYFYPNPPHCY |
| 274 | ANG186 | SSGPDIDCYFYPNPPIICY |
| 275 | ANG187 | DCYFYPNPLYCYEDWDYT |
| 276 | ANG188 | IWLDCYFYPNPPHCSLNS |
| 277 | ANG189 | QWNDCYFYPNPPHCYGRQ |
| 278 | ANG190 | GHMDCYYYPNPSHCYQQL |
| 279 | ANG192 | WLSQCYSYPNPPHCYTLF |
| 280 | ANG193 | SSLHMLDCYYYPNPPHCY |
| 281 | ANG194 | QSLSFLDCYFYPNPLHCY |
| 282 | ANG197 | NYYYCYLSPNPPHCYLSF |
| 283 | ANG198 | HFSDCYYFPNPPHCYESI |
| 284 | ANG199 | EVLDCFFYPNPPHCYKAL |
| 285 | ANG201 | RDTDCYFYPNPAIICYLGT |
| 286 | ANG203 | KCPMEPDWVSCDEWMLQK |
| 287 | ANG210 | LSLKCPLLPDWISCDEYY |
| 288 | ANG211 | KCPLLPDWLSCLEWQLME |
| 289 | ANG215 | KCPLLPDWVPCHEWLNVW |
| 290 | ANG217 | AMSLCPLLPDWASCNDYL |
| 291 | ANG218 | LCPRLPDWVSCHTWLERY |
| 292 | ANG219 | LSTKCPLLPDWVSCHEWL |
| 293 | ANG220 | LGWTELKCPLLPDWATCN |
| 294 | ANG222 | KCPLLPDWVSCHEWNVWL |
| 295 | ANG223 | KCPLLPDWISCAQWQRAV |
| 296 | ANG224 | VGSLCPLLPDWASCHEWL |
| 297 | ANG225 | RCPFLPDWLSCNEWLMIE |
| 298 | ANG228 | WYRKCPLLPDWVSCHEWY |
| 299 | ANG229 | TTLNCPLLPDWLTCQEFL |
| 300 | ANG231 | KCPLLPDWASCESWLEVR |
| 301 | ANG232 | HLDKCPLLPDWISCTDWL |
| 302 | ANG233 | KCPELPDWVTCDEFQGMQ |
| 303 | ANG239 | ATSKCPLLPDWVSCDEHL |
| 304 | ANG241 | SSGKCPLLPDWKSCDEWL |
| 305 | ANG242 | KCPLLPDWVSCHEWNIRE |
| 306 | ANG245 | KCPLLPDWFSCIIEYQEMF |

TABLE 10-continued

ANG2 binding MRDs

| SEQ ID: | Ref. No. | Peptide Sequence |
|---|---|---|
| 307 | ANG246 | KCPLLPDWVSCHTYLEES |
| 308 | ANG247 | EPPKCPMLPDWVSCDTWL |
| 309 | ANG248 | DVPHQLNCPLLPDWAACL |
| 310 | ANG249 | ETSKCPLLPDWVSCYQWL |
| 311 | ANG250 | MNVKCPLLPDWVSCLDYL |
| 312 | ANG252 | MLMKCPLLPDWASCDVWL |
| 313 | ANG256 | LMHECPLLPDWVSCHTFL |
| 314 | ANG257 | KCPLLPDWVSCETYLNGD |
| 315 | ANG258 | KCPLLPDWVSCDMYLERQ |
| 316 | ANG259 | KCPLLPDWASCDQWNEWN |
| 317 | ANG263 | YVSKCPFLPDWVSCHGWL |
| 318 | ANG266 | KCPFLPDWVSCHDYSQKY |
| 319 | ANG267 | FPPKCPLRPDWVSCHERH |
| 320 | ANG269 | ECPLLPDWVSCIIEWNRLII |
| 321 | ANG270 | SPVKCPFLPDWISCDLYL |
| 322 | ANG272 | TAFKCPPLPDWVSCLDWL |
| 323 | ANG274 | KCPLLPDWVSCQEWLSSK |
| 324 | ANG275 | HYDKCPLLPDWVSCHEFL |
| 325 | ANG277 | GLRKCPVLPDWVSCDNWL |
| 326 | ANG278 | SGFKCPLLPDWVSCTDCT |
| 327 | ANG279 | LASKCPLLPDWISCQTWL |
| 328 | ANG280 | KCPLLPDWVSCDQWRLLE |
| 329 | ANG281 | YFDKCPLLPDWLTCHEWM |
| 330 | ANG284 | LPSKCPLLPDWTSCDEYL |
| 331 | ANG303 | KSVSMKTCQDYPGWRYCQ |
| 332 | ANG335 | VNVFLKTCQDYPGWRYCH |
| 333 | ANG339 | PWPDCPVYRYCRHCHHKT |
| 334 | ANG355 | TGSTAKYCQDYPGWRYCH |
| 335 | ANG358 | LPMECYFYPNPEHCYLVP |
| 336 | ANG370 | TYTKCMTYPNPQYCFKHS |
| 337 | ANG371 | RFLECAWFPTPYFCHESE |
| 338 | ANG374 | QYDPCEYYIPCVKWG |
| 339 | ANG375 | GFHRCSTFPNPHYCYKTH |
| 340 | ANG376 | RWSYCEETMIGYPYCFTRP |
| 341 | ANG377 | AAFMLSCHSTDGQSWACMESH |
| 342 | ANG378 | RSFECRWQPEHPICAKGV |
| 343 | ANG380 | ILLRCAWYPAPPWCNIET |
| 344 | ANG381 | PHVICHYWKHPWCFQNS |
| 345 | ANG382 | VFYRCMKWPNPWWCYSQP |
| 346 | ANG383 | GFQRCKTFPNPHYCYKTH |
| 347 | ANG384 | DWSKCPKYPNPEWCYHPS |
| 348 | ANG385 | TYTKCMTYPNPQYCFKHN |
| 349 | ANG387 | SMWGCHMQPNYRECSLWI |
| 350 | ANG388 | PHVICHYCPHPWCFLNS |
| 351 | ANG389 | LELPCGKYPNMWFCYKVA |
| 352 | ANG390 | KERPCVWWKQPWCFQAS |
| 353 | ANG391 | QWFRCYEPPEPDWCRVRS |
| 354 | ANG393 | EWAFCYSYPNPDYCHEAV |
| 355 | ANG394 | TYRKCMTYPNPHYCFKHS |
| 356 | ANG395 | RYSLCMTYPNPYQCYKSN |
| 357 | ANG396 | PHVICHYWKHPWCFHNS |
| 358 | ANG397 | PWFSCYYFPNPSHCMDVV |
| 359 | ANG398 | LYDRCVCFPNLFWCEMTT |
| 360 | ANG399 | RSLACEFHPQKYHVQCALPH |
| 361 | ANG400 | NTLRCYSGVLVDAMVCFTSG |
| 362 | ANG403 | QYDPCEYDIPCVKWG |
| 363 | ANG404 | SWAQCYAYPNPDFCNRSG |
| 364 | ANG405 | PYEKCMTYPNPWYCFLTD |
| 365 | ANG406 | PYERCTKHPNPTYCWKNL |
| 366 | ANG407 | MYAMCQWIIPSPEQCRSPS |
| 367 | ANG599 | KCPLLPDWASCR |
| 368 | ANG637 | TYLQIIECYFYPNPPHCY |
| 369 | ANG638 | LTPSGSDCYFYPNPLHCY |
| 370 | ANG639 | GAYDCYFYPNPPHCYGTT |
| 371 | ANG640 | YLNHNYECYFFPNPTHCY |
| 372 | ANG641 | GFLTFYDCYFFPNPPHCF |
| 373 | ANG642 | TFIDCYFYPNPPHCYALW |
| 374 | ANG643 | ASDILLDCYFFPNPPHCR |
| 375 | ANG644 | LPLSWSDCYFYPNPPHCY |
| 376 | ANG645 | ALLDCYFYPNPAHCYITM |
| 377 | ANG646 | GMLDCYFYPNPPIICYLDR |
| 378 | ANG647 | SGTECYPYPNPPHCYSSD |
| 379 | ANG648 | SLEDCFFYPNPTLCYNNG |
| 380 | ANG649 | AFSRFLDCYFYPNPQHCY |
| 381 | ANG650 | GVYSFLECSFFPNPPYCY |
| 382 | ANG651 | EEGSSSDCYFYPNPRHCY |

TABLE 10-continued

ANG2 binding MRDs

| SEQ ID: | Ref. No. | Peptide Sequence |
|---|---|---|
| 383 | ANG652 | LTLLLDDCYFYPNPPHCY |
| 384 | ANG653 | LFHSMTDCYFYPNPRHCY |
| 385 | ANG654 | REQDCFFYPNPPHCYVDN |
| 386 | ANG655 | ASLGLYDCYYFPNPPNCY |
| 387 | ANG657 | RTGTLGDCYFYPNPRHCY |
| 388 | ANG658 | SPLDCYFYPNPPHCYYAH |
| 389 | ANG659 | IEGDCYFYPNPPHCYEQN |
| 390 | ANG660 | FNYSMYDCYFYPNPAHCY |
| 391 | ANG661 | LVLPLFDCYFYPNPPHCY |
| 392 | ANG662 | FHFVLYDCYFYPNPPYCF |
| 393 | ANG663 | HRADCYFFPNPMDCYQWR |
| 394 | ANG664 | STNLALDCYFYPNPPHCY |
| 395 | ANG665 | SPNDCYFYPNPPECYTHR |
| 396 | ANG666 | IVITSLACYFYPNPLHCY |
| 397 | ANG667 | GGVPMTDCYFYPNPRHCY |
| 398 | ANG668 | DFRDCYSFPNPTQCYINT |
| 399 | ANG670 | WPTDCFFFPNPPHCYHDG |
| 400 | ANG671 | HILDCYFYPNPPHCYLVT |
| 401 | ANG672 | DEADCYYYPNPPHCYSGH |
| 402 | ANG673 | TLVSMMDCYYYPNPPHCY |
| 403 | ANG674 | QSVRYMDCYFYPNPSHCY |
| 404 | ANG675 | WYDPYYACYFYPNPTYCY |
| 405 | ANG676 | LSGPFLDCYFYPNPTHCY |
| 406 | ANG677 | VMLDCYFYPNPLDCYWLT |
| 407 | ANG679 | SSLEHNDCYFYPNPMHCY |
| 408 | ANG680 | RHVDCYFYPNPPHCYLVL |
| 409 | ANG681 | IYPECYFYPNPKSCYSDQ |
| 410 | ANG682 | PPTSLADCYFFPNPLHCY |
| 411 | ANG683 | LLAACYFYPNPPLCFTST |
| 412 | ANG684 | GEEDCYFYPNPPIICYSEL |
| 413 | ANG685 | ECYFYPNPPHCYMEHRST |
| 414 | ANG686 | TEIECYFYPNPPQCYAIH |
| 415 | ANG687 | PRMDCYFYPNPPHCYNGQ |
| 416 | ANG688 | MSLPHQNCYFFPNPTYCY |
| 417 | ANG689 | YGDECYFFPNPPHCFSWD |
| 418 | ANG691 | FFESSFDCYFFPNPNHCY |
| 419 | ANG692 | MLVVPSDCYFYPNPSHCY |
| 420 | ANG693 | LQVDSLDCYFYPNPPHCY |
| 421 | ANG694 | QLMDCYFFPNPHHCFESK |
| 422 | ANG695 | DCYFYPNPPHCYNERYEA |
| 423 | ANG696 | SDMDCYFYPNPPIICFTPP |
| 424 | ANG697 | GADTMQWNDCYFFPNPTHCY |
| 425 | ANG698 | HIKDCYFFPNPPHCYKST |
| 426 | ANG699 | PHQRHLECYFYPNPPECY |
| 427 | ANG700 | SYLDFTDCYFYPNPPHCY |
| 428 | ANG701 | APGYTQDCYWFPNPPHCY |
| 429 | ANG702 | RFSSFHDCYFYPNPSHCY |
| 430 | ANG703 | HSHHLTDCYYFPNPLHCY |
| 431 | ANG704 | AQVDCYFFPNPTHCYFDR |
| 432 | ANG705 | MGDDCYFYPNPPRCYVKP |
| 433 | ANG706 | FLADCYLFPNPPHCYLDY |
| 434 | ANG707 | LGEDCYWYPNPPHCYGML |
| 435 | ANG708 | NDSVVSECYFFPNPPHCY |
| 436 | ANG709 | DCYFYPNPPSCYEVQGAS |
| 437 | ANG710 | GPWECFFYPNPLHCFKEP |
| 438 | ANG711 | PSADFAECFFYPNPPQCY |
| 439 | ANG712 | ASNDIHDCYFYPNPPHCY |
| 440 | ANG713 | SDTDCYFYPNPPHCYWDT |
| 441 | ANG714 | AFVHCYFFPNPQHCYHRL |
| 442 | ANG715 | MIFDCYFFPNPRHCYHEG |
| 443 | ANG716 | SYFLTWDCYTYPNPPHCY |
| 444 | ANG718 | TGFECYFYPNPRIICYNDI |
| 445 | ANG719 | LYPSLLDCYFYPNPTHCY |
| 446 | ANG721 | MVDECYFYPNPPHCYSNT |
| 447 | ANG722 | PLRSYMDCYWYPNPPHCY |
| 448 | ANG723 | WLGRLSDCYFYPNPPHCY |
| 449 | ANG724 | FHIDCYFYPNPPHCYTGA |
| 450 | ANG726 | NFRECVFYPNPPHCYDFG |
| 451 | ANG727 | KEIDCYFYPNPPHCYGKW |
| 452 | ANG728 | TNQDCYFYPNPPHCFRDH |
| 453 | ANG730 | SNAQCYFYPNPLHCYKNA |
| 454 | ANG731 | DCYFYPNPPHCYTVEGGK |
| 455 | ANG732 | QPMDCFFYPNPPHCYAEE |
| 456 | ANG733 | IVSREYDCYFYPNPTHCY |
| 457 | ANG734 | SMHDCYYYPNPTHCYRGT |
| 458 | ANG736 | DETECYWFPSPAIICYKDS |

TABLE 10-continued

ANG2 binding MRDs

| SEQ ID: | Ref. No. | Peptide Sequence |
|---|---|---|
| 459 | ANG740 | LGLDCYFYPNPPDCYHDA |
| 460 | ANG741 | FDEDCYFYPNPPHCYLLS |
| 461 | ANG742 | EHEACYFYPNPPHCYESS |
| 462 | ANG743 | PSYNIFECFFFPNPPHCY |
| 463 | ANG744 | SESDCYFYPNPPHCYAVV |
| 464 | ANG745 | HPFDCYFYPNPPHCYTRS |
| 465 | ANG746 | LILDCYFYPNPPHCYTST |
| 466 | ANG747 | YEFRWTDCYFYPNPPHCF |
| 467 | ANG748 | QSQNVVECYFYPNPPHCY |
| 468 | ANG749 | YRLDLSECYYYPNPLHCY |
| 469 | ANG751 | IPLDCYFYPNPPSCYIISY |
| 470 | ANG752 | AASQTSDCYFYPNPPSCY |
| 471 | ANG755 | THLDCYFYPNPPHCYSST |
| 472 | ANG756 | NTNDPFDCFFYPNPPHCY |
| 473 | ANG757 | IHKLDLDCYYYPNPPHCY |
| 474 | ANG762 | FSHPFTDCFFYPNPQHCY |
| 475 | ANG763 | TVYDCYFYPNPGHCYLQL |
| 476 | ANG765 | MVFHELDCYFYPNPPHCY |
| 477 | ANG766 | HSLLHWDCYFYPNPSHCY |
| 478 | ANG767 | QLRECYWFPNPSHCYIES |
| 479 | ANG769 | GLVDCYFYPNPPHCYWPH |
| 480 | ANG771 | LFENSLGCYFFPNPPHCY |
| 481 | ANG773 | FPPWFQDCFFYPNPPVCY |
| 482 | ANG774 | HALECYFYPNPLHCYTQP |
| 483 | ANG775 | DPVDCYFYPNPAHCYSTV |
| 484 | ANG776 | IVVYSADCFFYPNPRHCY |
| 485 | ANG777 | RMFDCYFYPNPPLCYNHI |
| 486 | ANG781 | LWYTTVNCYPCPNPLHCY |
| 487 | ANG782 | DYLSMLECYFYPNPSHCY |
| 488 | ANG783 | FMTSGVECYFYPNPPHCY |
| 489 | ANG784 | LFLNPYDCYFYPNPPQCY |
| 490 | ANG785 | IIQMTQIECYFFPNPQIICY |
| 491 | ANG786 | PWSPCYWYPNPRFCYEAS |
| 492 | ANG787 | LLVDCYYYPNPTHCSKNS |
| 493 | ANG788 | DCYFYPNPPHCYHDNEIE |
| 494 | ANG790 | PLLPFYDCYFYPNPSHCY |
| 495 | ANG791 | LVVDCYFYPNPPHCYDYS |
| 496 | ANG793 | RPSMHMECYFYPNPPYCY |
| 497 | ANG795 | GFLTSLDCYFYPNPPHCY |
| 498 | ANG797 | EVPDCYYYPNPPHCYEAN |
| 499 | ANG798 | RISSMVECYFYPNPPHCY |
| 500 | ANG799 | PFSVITECYFYPNPPHCY |
| 501 | ANG800 | PSADLLDCYFFPNPPHCS |
| 502 | ANG801 | QQADHIDCYFYPNPPYCY |
| 503 | ANG802 | STHDCFLYPNPPHCYWPQ |
| 504 | ANG803 | VASWKYDCYFYPNPLIICY |
| 505 | ANG804 | VDIDCYFYPNPPNCYNKA |
| 506 | ANG805 | LLDRFLDCYFYPNPSHCS |
| 507 | ANG806 | ECYFYPNPAHCYTGTNKE |
| 508 | ANG807 | LPHPHLDCYFYPNPAFCY |
| 509 | ANG808 | SYVDTTDCYFYPNPQHCY |
| 510 | ANG809 | PPLDCYFYPNPPNCYLGQ |
| 511 | ANG810 | WINDCYFYPNPSHCFVGD |
| 512 | ANG811 | YGTDCYFFPNPRNCYKIN |
| 513 | ANG812 | YSTDCYFYPNPPHCYGPH |
| 514 | ANG813 | PFSSFFDCYFYPNPHHCY |
| 515 | ANG814 | YVGIIMLDCYFYPNPPIICY |
| 516 | ANG815 | SMYDCLYFPNPPHCYIQN |
| 517 | ANG816 | FTQPMVDCYFYPNPPHCY |
| 518 | ANG817 | FNSTLFDCFFYPNPMHCY |
| 519 | ANG820 | RSLPIYECYFYPNPPHCY |
| 520 | ANG822 | VSLYYSACYFYPNPPWCN |
| 521 | ANG823 | SVLDCYFYPNPAHCYENV |
| 522 | ANG824 | VSTDCYFYPNPPHCYSVL |
| 523 | ANG825 | QGTHMLDCYFYPNPPNCY |
| 524 | ANG826 | TPSDCFFYPNPPHCYLMN |
| 525 | ANG827 | TWGVCYFYPNPPHCYEQL |
| 526 | ANG829 | VEEACYFYPNPPHCYEAV |
| 527 | ANG832 | DDSDCFFYPNPPRCYETY |
| 528 | ANG834 | YYYSYTHCYYYPNPTHCY |
| 529 | ANG835 | MTWFPNDCYFYPNPPYCY |
| 530 | ANG836 | LQLECYYYPNPTHCYETR |
| 531 | ANG837 | MGISFLDCYFFPNPQHCY |
| 532 | ANG838 | PSPYYSDCAWYPNPPYCY |
| 533 | ANG840 | SMSVYIDCFSYPNPPRCY |
| 534 | ANG841 | DCYFYPNPTHCYLKGGFV |

TABLE 10-continued

ANG2 binding MRDs

| SEQ ID: | Ref. No. | Peptide Sequence |
|---|---|---|
| 535 | ANG844 | DHSACYAFPNPSSCYNSR |
| 536 | ANG845 | PLNACYFPNPPHCYFLK |
| 537 | ANG846 | LLSVMQDCYFYPNPSHCY |
| 538 | ANG847 | PPPSSYECYFYPNPAHCY |
| 539 | ANG848 | SHTDCYYYPNPPHCYLEN |
| 540 | ANG849 | AGHECYFYPNPPHCYSEQ |
| 541 | ANG850 | AGMNDFDCYFFPNPPHCF |
| 542 | ANG853 | GSRDCYFYPNPKYCYIQD |
| 543 | ANG854 | SDSFLRDCYFYPNPPHCY |
| 544 | ANG855 | AWKDCFFYPNPSFCSYSS |
| 545 | ANG856 | PSLYELDCYFYPNPPHCY |
| 546 | ANG857 | YLHSFEDCYFYPNPAHCY |
| 547 | ANG858 | LTIEHQDCYFYPNPPHCY |
| 548 | ANG861 | YVMGGDDCYFYPNPPECY |
| 549 | ANG862 | GNIACYFYPNPPHCYNVH |
| 550 | ANG863 | SGMECYFFPNPPHCYDLK |
| 551 | ANG866 | LGLRHYACYLYPNPPHCY |
| 552 | ANG867 | ARSSQFECYFYPNPPHCY |
| 553 | ANG869 | YPGPFTGCYFYPNPLQCY |
| 554 | ANG871 | NERDCYFYPNPPHCYQNG |
| 555 | ANG872 | LDSECFFYPNPPHCYNTL |
| 556 | ANG873 | PYLDCAEYPNPLYCYESE |
| 557 | ANG874 | IGYPFSDCYFYPNPPHCY |
| 558 | ANG875 | WNFDCYFYPNPPLCYNME |
| 559 | ANG877 | AAVECLFYPNPPHCYERA |
| 560 | ANG879 | SNVDCYFYPNPPNCFVIID |
| 561 | ANG880 | VLSFFQDCYFYPNPANCY |
| 562 | ANG881 | SPPVFWECYFYPNPTHCY |
| 563 | ANG882 | PNQSNYDCYFYPNPPHCY |
| 564 | ANG883 | LAFDLSDCYFYPNPPHCS |
| 565 | ANG884 | FNEECYFYPNPPHCYGEY |
| 566 | ANG885 | LVVTAFDCYFYPNPPYCY |
| 567 | ANG886 | SLNPSVDCYFYPNPAHCY |
| 568 | ANG887 | ALHDCYFYPNPQHCYQA |
| 569 | ANG889 | FSPGEVDCYFYPNPPHCK |
| 570 | ANG890 | ADTDCYFYPNPPHCYDIT |
| 571 | ANG891 | LSLELSECYFFPNPPHCY |
| 572 | ANG894 | AVLEHFDCYFYPNPPHCY |
| 573 | ANG895 | MLWDMSGCYFYPNPPHCY |
| 574 | ANG896 | SKQDCYFYPNPSHCYLDQ |
| 575 | ANG897 | YDLLLHDCYVFPNPPHCY |
| 576 | ANG898 | ECYFYPNPPDCFYLIIQRR |
| 577 | ANG899 | DHVECYFYPNPLHCYKDR |
| 578 | ANG901 | PRPLVIDCYFFPNPPHCY |
| 579 | ANG902 | DCYFYPNPPHCYIEHKPS |
| 580 | ANG903 | SHFSFKDCYFYPNPAHCY |
| 581 | ANG904 | SLRDCYFYPNPAHCRNNM |
| 582 | ANG906 | YGNECYFFPNPPHCYHRD |
| 583 | ANG907 | DTLDCYYFPNPPHCYSSQ |
| 584 | ANG909 | QWNPHYHCFFYPNPPHCY |
| 585 | ANG911 | TSLDCYFYPNPPHCYETP |
| 586 | ANG912 | KWARGMECFFYPNPPDCY |
| 587 | ANG913 | RLVDCYYYPNPLHCYDRS |
| 588 | ANG914 | THKDCYFFPNPPHCYTKT |
| 589 | ANG915 | PLKDCYFYPNPLHCYLVS |
| 590 | ANG916 | APHILQDCYFYPNPRHCY |
| 591 | ANG917 | LSILYPSCYFYPNPEHCQ |
| 592 | ANG918 | ECYFYPNPPECYNVDDQA |
| 593 | ANG919 | ECYFYPNPPHCYVLKQQI |
| 594 | ANG920 | ISTRNTDCYFYPNPPHCY |
| 595 | ANG923 | FYYDCFFYPNPPNCYNSF |
| 596 | ANG924 | FSHLEQDCYFYPNPPHCY |
| 597 | ANG925 | SPVDCYFYPNPPHCYDWD |
| 598 | ANG926 | PYQLMTDCYFFPNPPHCY |
| 599 | ANG929 | ESFQNMDCYFYPNPPYCY |
| 600 | ANG930 | PRKSFHDCYFYPNPPHCY |
| 601 | ANG932 | SWPNHMECYFFPNPPHCY |
| 602 | ANG934 | KSVGNTDCYFFPNPPHCY |
| 603 | ANG935 | TIYDCYIYPNPRHCYKLN |
| 604 | ANG936 | ECYFYPNPPHCYHALTSK |
| 605 | ANG937 | FYQSWVDCYFYPNPPHCS |
| 606 | ANG939 | YALDLGGCYWFPNPPIICY |
| 607 | ANG940 | SIFLSLDCYFFPNPSNSL |
| 608 | ANG942 | GVYSFDQCYVFPNPPDCY |
| 609 | ANG943 | VVLHYGDCYYYPNPPYCY |
| 610 | ANG944 | RALDCYFYPNPQHCYQGT |

TABLE 10-continued

ANG2 binding MRDs

| SEQ ID: | Ref. No. | Peptide Sequence |
|---|---|---|
| 611 | ANG945 | SPHECYFYPNPPHCYADR |
| 612 | ANG946 | DVQIEFDCYFYPNPPYCY |
| 613 | ANG947 | YPMNSHDCYFYPNPPQCY |
| 614 | ANG948 | SPAHCSYCPFPPNSCFCY |
| 615 | ANG949 | LRLDLEECYWYPNPPYCK |
| 616 | ANG951 | GSALLSDCYFYPNPPHCY |
| 617 | ANG952 | SVLALEDCYFYPNPHHCY |
| 618 | ANG954 | PTAVLMECYFYPNPDYCY |
| 619 | ANG955 | YGTECYFYPNPAHCYSNE |
| 620 | ANG956 | HWYFCPNPPNPPQCHLKW |

TABLE 11

VEGF binding MRDs

| SEQ ID: | Ref. No. | Peptide Sequence |
|---|---|---|
| 629 | VGF1 | WCWVPGPIQCY |
| 630 | VGF2 | CMWEMPWWFCQ |
| 631 | VGF3 | TCTWVMPWWFCE |
| 632 | VGF4 | ICLWQMPWWFCE |
| 633 | VGF6 | GDWEWVWDWCF |
| 634 | VGF8 | ECRWVMPWWFCE |
| 635 | VGF9 | ACWKAMPWWFCT |
| 636 | VGF10 | FCMVQVPWWLCK |
| 637 | VGF11 | FYQWFEEQLM |
| 638 | VGF13 | MCWLVPGPMICH |
| 639 | VGF14 | FCMYKPLMFLCP |
| 640 | VGF15 | HCWWLYTWDPCI |
| 641 | VGF16 | HCYVYVPWWLCP |
| 642 | VGF17 | MCWTPVPWWLCL |
| 643 | VGF18 | TCWKPTPWWLCD |
| 644 | VGF19 | SCWFKIPWWLCP |
| 645 | VGF20 | YCQPMWWNMACW |
| 646 | VGF21 | YCFWIPPEWYCV |
| 647 | VGF23 | GCWEWRPHWLCV |
| 648 | VGF24 | ECTWTMPWWFC |
| 649 | VGF25 | TCWKPAPWWLCA |
| 650 | VGF27 | TCWKPTPWWLCA |
| 651 | VGF29 | KCNFNPWKAACG |

TABLE 11-continued

VEGF binding MRDs

| SEQ ID: | Ref. No. | Peptide Sequence |
|---|---|---|
| 652 | VGF30 | TCWKPAPWWLCD |
| 653 | VGF31 | TSWKAAAWGLCA |
| 654 | VGF32 | ACWKATPWWLCD |
| 655 | VGF34 | TCWKATPWWLCA |
| 656 | VGF35 | ACWKAAPWWLCD |
| 657 | VGF36 | TCWKAAPWWLCD |
| 658 | VGF37 | ACWKAPWWLCD |
| 659 | VGF38 | TCWKATPWWLCD |
| 660 | VGF39 | TCWKAAPWWLCA |
| 661 | VGF40 | ACWKAAPWWLCA |
| 662 | VGF47 | WCAGFPPNYPCY |
| 663 | VGF48 | WCNGFPPNYPCS |
| 664 | VGF49 | WCNGFPPNYPCY |
| 665 | VGF53 | WCNGFPPNYPCA |
| 666 | VGF57 | GCVKEVPWWLCI |
| 667 | VGF59 | GCVKQVPWWLCV |
| 668 | VGF60 | GCVTQVPWWLCI |
| 669 | VGF62 | ACVKEVPWWLCI |
| 670 | VGF63 | GCVKQVPWWLCI |
| 671 | VGF65 | ACVAEVPWWLCI |
| 672 | VGF67 | GCVKAAPWWLCV |
| 673 | VGF69 | GCVKEVPWWLCV |
| 674 | VGF70 | GCVKPAPWWLCI |
| 675 | VGF71 | GCVTEVPWWLCI |
| 676 | VGF72 | GCVAQVPWWLCI |
| 677 | VGF76 | ACVKEAPWWLCI |
| 678 | VGF82 | GCVAEVPWWLCI |
| 679 | VGF83 | ACVKQVPWWLCI |
| 680 | VGF85 | GCVKPAPWWLCV |
| 681 | VGF95 | GCVAEVPWWLCT |
| 682 | VGF99 | GGVKQVASWLGT |
| 683 | VGF100 | GAVTEAAWWLAI |
| 684 | VGF101 | GGVEAAAWWVGI |
| 685 | VGF104 | GCVKQVPWGLCI |
| 686 | VGF107 | VEPNCDIHVMWEWECFERL |
| 687 | VGF131 | WCAGFPPTSAGY |
| 688 | VGF140 | TAWEAAASWLCA |
| 689 | VGF146 | TCGKAAAAWLAA |

TABLE 11-continued

VEGF binding MRDs

| SEQ ID: | Ref. No. | Peptide Sequence |
|---|---|---|
| 690 | VGF152 | TGWKPTAWGVGD |
| 691 | VGF156 | ASWKPAPWWLCA |
| 692 | VGF162 | TSGKATPGGACD |

TABLE 12

IGF1R binding MRDs

| SEQ ID: | Ref. No. | Peptide Sequence |
|---|---|---|
| 698 | IGF3 | DSGFYMGLHK |
| 699 | IGF10 | MDQFHWALLG |
| 700 | IGF21 | LCQEFHELCF |
| 701 | IGF22 | LCDEFVELCF |
| 702 | IGF23 | LCEEFHELCF |
| 703 | IGF24 | LCDEFKELCF |
| 704 | IGF25 | LCAEFPELCF |
| 705 | IGF27 | ICIIIFWQTCNGQAGQGGGSGGS KCDILEMMCN |
| 706 | IGF28 | LCMEFPELCF |
| 707 | IGF29 | LCMEFKELCF |
| 708 | IGF30 | LCEEFPVLCF |
| 709 | IGF31 | LCQEFIELCF |
| 710 | IGF32 | LCLEFIIELCF |
| 711 | IGF33 | LCQEFSELCF |
| 712 | IGF34 | LCEEFAELCF |
| 713 | IGF35 | LCFEFVELCF |
| 714 | IGF36 | LCSEFQVLCF |
| 715 | IGF38 | LCLEFVELCF |
| 716 | IGF39 | LCWEFPVLCF |
| 717 | IGF40 | LCEEFIELCF |
| 718 | IGF42 | WCEISTTFCNGQAGQGGGGGG SQCQLLHMFCH |
| 719 | IGF43 | LCMEFEQLCF |
| 720 | IGF44 | LCLEFRELCF |
| 721 | IGF45 | LCQEFAELCF |
| 722 | IGF46 | LCQEFKELCF |
| 723 | IGF48 | LCLEFEELCF |
| 724 | IGF49 | LCYEFEELCF |
| 725 | IGF50 | LCMEFQELCF |

TABLE 12-continued

IGF1R binding MRDs

| SEQ ID: | Ref. No. | Peptide Sequence |
|---|---|---|
| 726 | IGF51 | LCIIEFEELCF |
| 727 | IGF52 | LCYEFHELCF |
| 728 | IGF53 | LCDEFQELCF |
| 729 | IGF54 | WCQIQAFHCRGQAGQGGGSAG GGSSCNILQLMCS |
| 730 | IGF55 | FECVLWNFVCK |
| 731 | IGF56 | LCAEFPVLCF |
| 732 | IGF57 | LCTEFKELCF |
| 733 | IGF59 | LCQEFNELCF |
| 734 | IGF60 | AMTLDEWIRMRGQAGGSWVD PAFWGDF |
| 735 | IGF61 | FYGWFEEQIL |
| 736 | IGF64 | FYEQLEKLVY |
| 737 | IGF66 | FYEWFEEQLI |
| 738 | IGF67 | FYEWFEAQIM |
| 739 | IGF68 | FYDWFDMHVK |
| 740 | IGF69 | SFYDMIELLIGQAGQGGGSGGG GGGSTIHFAQEEHP |
| 741 | IGF72 | FYEWFEAQVM |
| 742 | IGF73 | FYDWFAEQVI |
| 743 | IGF74 | FYEWFTEQVN |
| 744 | IGF75 | FYEWFIIEQVI |
| 745 | IGF76 | QFYEWFEAQT |
| 746 | IGF77 | FYEWFQLQMD |
| 747 | IGF78 | VHWEGYQWVY |
| 748 | IGF79 | FYETLFELAY |
| 749 | IGF82 | FYEWFEAALI |
| 750 | IGF83 | FYDWFDMQVQ |
| 751 | IGF84 | FYEWFEPQVT |
| 752 | IGF85 | EFYYWFFDQY |
| 753 | IGF91 | FYEWFDMQVK |
| 754 | IGF92 | ADFYQWFQNQV |
| 755 | IGF93 | SFYAWFDEQV |
| 756 | IGF95 | EVWEGYDWLY |
| 757 | IGF196 | SHPLCTEFIELCFGFE |
| 758 | IGF253 | VPFLCLEFSELCFTDP |
| 759 | IGF254 | ADLLCAEFTELCFDVI |
| 760 | IGF255 | AIIPLCLEFSELCFEAV |
| 761 | IGF256 | PHPLCQEFEELCFETV |

TABLE 12-continued

IGF1R binding MRDs

| SEQ ID: | Ref. No. | Peptide Sequence |
|---|---|---|
| 762 | IGF257 | ASQLCGEFPELCFDKV |
| 763 | IGF258 | IPLLCFEFVELCFDLT |
| 764 | IGF259 | DDALCKEFPELCFQNV |
| 765 | IGF260 | IPYLCLEFPVLCFQDT |
| 766 | IGF261 | PHILCLEFAELCFDHL |
| 767 | IGF263 | VPALCLEFKELCFHDR |
| 768 | IGF264 | TPALCLEFWELCFDEA |
| 769 | IGF265 | VPPLCMEFTELCFHDP |
| 770 | IGF266 | AHPLCVEFSELCFNED |
| 771 | IGF267 | IPMLCWEFTELCFDLN |
| 772 | IGF268 | VPQLCLEFQELCFGEH |
| 773 | IGF269 | VPSLCLEFPELCFNEA |
| 774 | IGF270 | PHPLCLEFIELCFGTH |
| 775 | IGF271 | IPFLCLEFEELCFHLD |
| 776 | IGF272 | EHPLCLEFPELCFSHP |
| 777 | IGF273 | PHYLCLEFSELCFDER |
| 778 | IGF274 | TPFLCLEFHELCFGEH |
| 779 | IGF275 | PQLLCLEFAELCFWDI |
| 780 | IGF276 | PHALCREFHELCFEKS |
| 781 | IGF277 | RLPLCVEFSELCFDLR |
| 782 | IGF278 | VPALCWEFPELCFHYQ |
| 783 | IGF279 | TPSLCLEFSELCFADG |
| 784 | IGF280 | VHWLCAEFEELCFDQT |
| 785 | IGF281 | LHFLCLEFQELCFDSN |
| 786 | IGF282 | VPPLCLEFPELCFTDS |
| 787 | IGF283 | DHWLCIEFSELCFGKS |
| 788 | IGF284 | EHPLCEEFKELCFGTN |
| 789 | IGF285 | DWRLCQEFTELCFMDG |
| 790 | IGF286 | YLSLCAEFTELCFIITE |
| 791 | IGF287 | PPLLCFEFPELCFGYE |
| 792 | IGF288 | DHKLCNEFPELCFHDV |
| 793 | IGF289 | AHALCLEFLELCFEER |
| 794 | IGF290 | IPFLCYEFQELCFGTL |
| 795 | IGF291 | AELLCREFTELCFLRD |
| 796 | IGF292 | APGLCIEFRELCFDEK |
| 797 | IGF293 | YYALCAEFQELCFDEH |
| 798 | IGF294 | VPLLCFEFPELCFGYQ |
| 799 | IGF295 | VPSLCIEFSELCFDSP |
| 800 | IGF296 | DYALCLEFRELCFGMN |
| 801 | IGF297 | AIIRLCQEFVELCFGET |
| 802 | IGF298 | PHFLCMEFPVLCFNDS |
| 803 | IGF299 | IPQLCLEFSELCFGMT |
| 804 | IGF300 | RTDLCMEFYELCFHSD |
| 805 | IGF301 | KPPLCEEFHELCFDLT |
| 806 | IGF303 | PHKLCLEFRELCFDEL |
| 807 | IGF304 | LHFLCVEFVELCFDEA |
| 808 | IGF305 | VPRLCYEFPELCFHKQ |
| 809 | IGF306 | PHPLCLEFEELCFTER |
| 810 | IGF307 | AARLCSEFPELCFHAS |
| 811 | IGF308 | RHSLCIEFPELCFDEY |
| 812 | IGF309 | AGRLCAEFHELCFGTN |
| 813 | IGF310 | ASRLCMEFPELCFDRK |
| 814 | IGF311 | HPALCVEFVELCFGHE |
| 815 | IGF312 | IPPLCLEFQELCFGWD |
| 816 | IGF313 | DDALCAEFNELCFEVT |
| 817 | IGF314 | APPLCIEFEELCFGFL |
| 818 | IGF315 | SHPLCLEFHELCFTDA |
| 819 | IGF316 | IHPLCLEFTELCFHEV |
| 820 | IGF317 | QEPLCVEFRELCFNED |
| 821 | IGF318 | IPDLCREFEELCFGSK |
| 822 | IGF319 | IIIPLCKEFPELCFDVD |
| 823 | IGF320 | GPLLCAEFVELCFGDD |
| 824 | IGF321 | YPPLCLEFPELCFWNH |
| 825 | IGF322 | SHNLCLEFVELCFGDV |
| 826 | IGF323 | PPLLCLEFHELCFHIE |
| 827 | IGF324 | AHVLCLEFHELCFDMG |
| 828 | IGF325 | RPLLCYEFSELCFDIT |
| 829 | IGF326 | HPRLCLEFSELCFDEM |
| 830 | IGF327 | IPALCLEFSELCFSTS |
| 831 | IGF328 | APSLCLEFIELCFDNM |
| 832 | IGF329 | PHPLCREFPVLCFDDT |
| 833 | IGF330 | VHPLCLEFAELCFVNY |
| 834 | IGF331 | VPSLCMEFPELCFTTE |
| 835 | IGF332 | VPLLCLEFAELCFHVE |
| 836 | IGF334 | AMRLCNEFIIELCFGVV |

TABLE 12-continued

IGF1R binding MRDs

| SEQ ID: | Ref. No. | Peptide Sequence |
|---|---|---|
| 837 | IGF335 | EERLCKEFPELCFMMT |
| 838 | IGF336 | TPSLCREFTELCFDSD |
| 839 | IGF337 | VHPLCMEFTELCFHLR |
| 840 | IGF338 | AGALCKEFPILCFTME |
| 841 | IGF339 | EHPLCREFSELCFGMG |
| 842 | IGF340 | SSSLCLEFSELCFHDD |
| 843 | IGF341 | ALRLCNEFPELCFGGT |
| 844 | IGF343 | IPLLCLEFPVLCFENE |
| 845 | IGF344 | APLLCLEFPELCFGWD |
| 846 | IGF345 | PALLCQEFAELCFDMP |
| 847 | IGF346 | YLIILCREFTELCFDEG |
| 848 | IGF347 | AHWLCLEFKELCFGND |
| 849 | IGF348 | VPSLCFEFEELCFDWS |
| 850 | IGF349 | VPSLCLEFQELCFTTE |
| 851 | IGF350 | PHPLCLEFPELCFGAE |
| 852 | IGF351 | DSRLCAEFPELCFEDV |
| 853 | IGF352 | AATLCLEFSELCFDMS |
| 854 | IGF353 | IPHLCKEFPELCFEQR |
| 855 | IGF354 | SYLLCREFSELCFDKT |
| 856 | IGF355 | VPYLCLEFAELCFQVD |
| 857 | IGF356 | VPPLCVEFSELCFDAP |
| 858 | IGF357 | MELLCFEFSELCFGSH |
| 859 | IGF358 | TVALCKEFPELCFDIV |
| 860 | IGF359 | DPYLCLEFEELCFRFV |
| 861 | IGF360 | TPALCLEFAELCFEDS |
| 862 | IGF361 | RHPLCVEFPELCFVDY |
| 863 | IGF362 | VHPLCIEFPALCFDTR |
| 864 | IGF363 | YLALCYEFRELCFGDQ |
| 865 | IGF364 | APLLCLEFPELCFEDI |
| 866 | IGF365 | VHYLCLEFQELCFDEL |
| 867 | IGF366 | RPSLCLEFRELCFDTL |
| 868 | IGF367 | APSLCWEFKELCFDSE |
| 869 | IGF369 | AHALCLEFSELCFDVT |
| 870 | IGF370 | TQYLCIEFAELCFDTI |
| 871 | IGF371 | AGALCREFAELCFHNH |
| 872 | IGF372 | TPPLCFEFPELCFHLS |
| 873 | IGF373 | SERLCLEFAELCFGHG |
| 874 | IGF374 | AHWLCLEFPELCFDKL |
| 875 | IGF375 | DLHLCREFSELCFSSP |
| 876 | IGF376 | TPSLCLEFPELCFHGT |
| 877 | IGF377 | APSLCLEFRELCFEDY |
| 878 | IGF378 | VPSECLEFADLCFHDI |
| 879 | IGF379 | MPALCLEFRELCFEDP |
| 880 | IGF380 | YMRLCYEFSELCFHAS |
| 881 | IGF381 | APSLCTEFRELCFDII |
| 882 | IGF382 | VPPLCLEFAELCFYAD |
| 883 | IGF384 | TPSLCVEFRELCFDDL |
| 884 | IGF385 | QEALCIEFHELCFEEY |
| 885 | IGF386 | ADRLCREFSELCFDVV |
| 886 | IGF387 | AHPLCLEFPVLCFDDE |
| 887 | IGF388 | RPVLCIEFPELCFNET |
| 888 | IGF389 | DVKLCQEFPELCFESY |
| 889 | IGF390 | VPALCFEFAELCFHIE |
| 890 | IGF391 | AYALCHEFQELCFETT |
| 891 | IGF392 | AALLCHEFTELCFLEA |
| 892 | IGF393 | QHLLCIEFNELCFNDV |
| 893 | IGF394 | IPPLCLEFWELCFDAP |
| 894 | IGF395 | AHRLCMEFAELCFGNA |
| 895 | IGF396 | RPSLCQEFVELCFEEA |
| 896 | IGF397 | PHRLCIEFPELCFDVV |
| 897 | IGF398 | AQALCLEFMELCFDVR |
| 898 | IGF399 | ADALCAEFKELCFNIK |
| 899 | IGF400 | GHKLCTEFIELCFDVN |
| 900 | IGF401 | DEQLCLEFVELCFEQT |
| 901 | IGF402 | VYALCREFSELCFYGN |
| 902 | IGF404 | AGALCAEFPELCFGGT |
| 903 | IGF405 | PPSLCLEFPELCFHRS |
| 904 | IGF406 | IPALCIEFSELCFWPS |
| 905 | IGF407 | VQPLCLEFSELCFDSA |
| 906 | IGF408 | EHILCQEFSELCFNRD |
| 907 | IGF409 | VPPLCLEFTELCFIID |
| 908 | IGF410 | IPPLCLEFWELCFDER |
| 909 | IGF411 | PHPLCREFPDLCFDHS |
| 910 | IGF412 | PHWLCEEFEELCFEAI |
| 911 | IGF413 | DRLLCSEFYELCFDDN |

TABLE 12-continued

IGF1R binding MRDs

| SEQ ID: | Ref. No. | Peptide Sequence |
|---|---|---|
| 912 | IGF414 | PAALCLEFSELCFTQQ |
| 913 | IGF416 | YSSLCLEFSELCFDQM |
| 914 | IGF417 | RPALCGEFKELCFDGA |
| 915 | IGF419 | YNALCNEFIELCFHVN |
| 916 | IGF420 | PHWLCLEFAELCFGSG |
| 917 | IGF421 | APPLCLEFRELCFGEQ |
| 918 | IGF423 | TPQLCLEFTDLCFEDT |
| 919 | IGF424 | VPHLCIEFAELCFEGT |
| 920 | IGF425 | RMDLCREFTELCFTDS |
| 921 | IGF426 | AHQLCIEFAELCFNDG |
| 922 | IGF427 | PPLLCLEFPVLCFDSP |
| 923 | IGF428 | PHALCLEFSELCFWSL |
| 924 | IGF429 | VHQLCMEFEELCFGGA |
| 925 | IGF430 | PHALCLEFHELCFDSN |
| 926 | IGF431 | YRALCFEFAELCFDEN |
| 927 | IGF485 | EFYQGLERLV |
| 928 | IGF498 | YFYWFQEMVM |
| 929 | IGF500 | FYQWFEKQLM |
| 930 | IGF503 | QEFYTMWFALQI |
| 931 | IGF504 | ECDFYCGIYTL |
| 932 | IGF507 | LCREFQELCF |
| 933 | IGF511 | GFYEWFEMQL |
| 934 | IGF512 | FYEWFQAQLT |
| 935 | IGF514 | GFYEWFEMQM |
| 936 | IGF515 | YLSPDDMCYEFPELCF |
| 937 | IGF516 | KTSQDMLCWEFEELCF |
| 938 | IGF517 | QTTPHILCLEFPELCF |
| 939 | IGF518 | LTSWELLCFEFEELCF |
| 940 | IGF519 | EVSPEDLCQEFVELCF |
| 941 | IGF520 | WYVDPPLCFEFPELCF |
| 942 | IGF521 | LCAEFAELCFEDTVRY |
| 943 | IGF522 | PGLEIPQLCKEFPELCFTMDDDF |
| 944 | IGF523 | LCAEFRELCFHLPAQA |
| 945 | IGF524 | MRVESLQLCKEFPELCFFSHGWT |
| 946 | IGF526 | RLTPQDLCFEFSELCF |
| 947 | IGF527 | LSSYDVLCQEFSELCF |
| 948 | IGF532 | GPMEVHDLCKEFSELCF |
| 949 | IGF533 | LRPESIALCKEFPELCFEGWKSA |
| 950 | IGF534 | QSLDIPGLCKEFPELCFEMTGMR |
| 951 | IGF535 | LCSEFIELCFDQVPLR |
| 952 | IGF536 | TSSALKLCQEFPELCF |
| 953 | IGF537 | LSSYMLLCMEFSELCF |
| 954 | IGF538 | YVIPHPLCLEFSELCF |
| 955 | IGF539 | DPSVPALCHEFPELCF |
| 956 | IGF540 | QGWTHPLCLEFQELCF |
| 957 | IGF541 | FALVPSLCLEFNELCF |
| 958 | IGF542 | MSSNSIKLCKEFPELCFHIHGKD |
| 959 | IGF543 | LCLEFRELCFDLSEPH |
| 960 | IGF544 | MRLESLELCKEFPELCFSTDLTL |
| 961 | IGF545 | TMLEIPQLCKEFPELCFHDTTVW |
| 962 | IGF546 | LCQEFKELCFEAEFQA |
| 963 | IGF547 | KVTPFMLCQEFPELCF |
| 964 | IGF548 | APGEHWLCLEFQELCF |
| 965 | IGF549 | VFQMIIPLCLEFPELCF |
| 966 | IGF551 | YEPPHSLCLEFVELCF |
| 967 | IGF552 | PPIMHPLCLEFAELCF |
| 968 | IGF553 | LCAEFIELCFDLEPGI |
| 969 | IGF554 | LSPEFPDLCLYFGLDC |
| 970 | IGF555 | GSLSVPKLCKEFPELCFDKKMSG |
| 971 | IGF556 | QRFEPDDLCKEFPELCFNLNMNV |
| 972 | IGF557 | LCLEFAELCFGWDDNS |
| 973 | IGF559 | RIYPSELCLEFAELCF |
| 974 | IGF560 | QSYEHWLCQEFHELCF |
| 975 | IGF561 | SSPPHWLCLEFEELCF |
| 976 | IGF562 | RMSEMDLCAEFFELCF |
| 977 | IGF563 | LCAEFHELCFDISNQE |
| 978 | IGF564 | LCFEFAELCFDTEFYN |
| 979 | IGF565 | PRLCKEFPELCFEVPVIGNEEHYSL |
| 980 | IGF566 | QGSKVLELCKEFPELCFDRANRL |
| 981 | IGF567 | TLSPHPLCVEFPELCF |
| 982 | IGF568 | SEWYHPLCVEFSELCF |
| 983 | IGF569 | SAGEIIWLCVEFQELCF |
| 984 | IGF570 | LSPAELLCLDFPELCF |
| 985 | IGF571 | LTPAERLCDEFPVLCF |
| 986 | IGF572 | LCKEFPELCFDERDKK |

TABLE 12-continued

IGF1R binding MRDs

| SEQ ID: | Ref. No. | Peptide Sequence |
|---|---|---|
| 987 | IGF573 | LTSADLLCSEFRELCF |
| 988 | IGF574 | RITPNDLCQEFQELCF |
| 989 | IGF575 | FAPPHPLCIEFQELCF |
| 990 | IGF577 | VGKEVFRLCKEFPELCFYPAISQ |
| 991 | IGF578 | LRFESPQLCKEFPELCFFESNGW |
| 992 | IGF579 | YRAERPELCKEFPELCFFENDWW |
| 993 | IGF580 | LCREFIELCFDIETEV |
| 994 | IGF581 | RTVVPPLCLEFPELCF |
| 995 | IGF582 | LYTPQSMCAEFTELCF |
| 996 | IGF583 | GLVQHNLCLEFVELCF |
| 997 | IGF584 | IDRPPDLCKEFPELCF |
| 998 | IGF585 | VFLDAPELCKEFSELCFGYSDSL |
| 999 | IGF586 | RFSESPPLCKEFPELCFWSPPFP |
| 1000 | IGF589 | RDFTYDTDWEGYSWLY |
| 1001 | IGF592 | IPGLCLEFPELCFHQW |
| 1002 | IGF596 | EPWEGYSWLY |
| 1003 | IGF600 | PLWEGYSWLYSQEAGN |
| 1004 | IGF602 | FASGEYPPWEGYRWLY |
| 1005 | IGF603 | WGDDHWEGYDWLYAQT |
| 1006 | IGF604 | RDEAEWEGYNWLYSQM |
| 1007 | IGF605 | DTWEGYLWLYAQTADA |
| 1008 | IGF607 | YTRSLGDPWEGYSWLY |
| 1009 | IGF611 | SAWEGYAWFDLQVESG |
| 1010 | IGF612 | YSIQDHGAWPGYDWLY |
| 1011 | IGF613 | QWGHKSEQWEGYSWLY |
| 1012 | IGF614 | QQPNTWEGYSWLYSQV |
| 1013 | IGF616 | DLWEGYLWFDSQVLGD |
| 1014 | IGF617 | IPLLCLEFPVLCFENE |
| 1015 | IGF618 | SYDYSQGEWEGYQWLY |
| 1016 | IGF619 | HDSALMAEWEGYNWLY |
| 1017 | IGF623 | QPWEGYKWLYEAA |
| 1018 | IGF625 | PAASAWEGYKWLYDQV |
| 1019 | IGF630 | LSTDWSGDWEGYAWLY |
| 1020 | IGF633 | LLASEWEGYEWLYGQI |
| 1021 | IGF1270 | ALPECQDLMFYECLFTL |
| 1022 | IGF1271 | FYNTCQFVGMEFYQCLDWL |
| 1023 | IGF1272 | RDPVCETKDVFYQMLCTVAF |
| 1024 | IGF1273 | RSLVCSEEEPFYLALCRLTH |
| 1025 | IGF1275 | SVLGCDDVGFYQCLEFL |
| 1026 | IGF1276 | LEHLCQTRDGFYELMCTLAL |
| 1027 | IGF1277 | AARWCDMQQHSFYECLQVL |
| 1028 | IGF1278 | NALGCQEEWETLDQCLMRL |
| 1029 | IGF1279 | AVPKCPGWDFYTALECLSRT |
| 1030 | IGF1280 | EPRLCHNYPDFYQCMSFL |
| 1031 | IGF1281 | ASQTCIGMDFYSGLECLLGW |
| 1032 | IGF1282 | WVEECHNLHWDLKHCLMHQ |
| 1033 | IGF1283 | SVPSCIDYYGDWFLCLAAP |
| 1034 | IGF1284 | NNTLCRGVPTFEECVFIL |
| 1035 | IGF1285 | SNGSCHIVDFYGWFQCQTSA |
| 1036 | IGF1286 | LTEPCSQHSMFYSMLCELAF |
| 1037 | IGF1287 | RDRVCHNKTFFHCLFSIFPDG |
| 1038 | IGF1290 | YGLGCSQMDFYQCLDML |
| 1039 | IGF1291 | DVSHCHIMFWDFQQCLEYL |
| 1040 | IGF1292 | NPATCYQKSYQFEQCLMYL |
| 1041 | IGF1328 | VDVLCHHVDFYECMDRL |
| 1042 | IGF1329 | WLSQCEAKEIDFYMCLAGQAG |
| 1043 | IGF1330 | GPKECIGVPNFDLCMAML |
| 1044 | IGF1331 | LEDWCLHLDFYQCLEAV |
| 1045 | IGF1332 | TMPTCEKLNFYECMNLL |
| 1046 | IGF1333 | SLSICTYADFYECMDLL |
| 1047 | IGF1334 | YIRECHELQNFTEGIHCLVTR |
| 1048 | IGF1335 | TFKDCAHIPGIDFCLWRL |
| 1049 | IGF1336 | SWDPCFESDEFIIMKLCVLMD |
| 1050 | IGF1337 | LLSECYDKDFYECLGLE |
| 1051 | IGF1338 | YQDMCEDMSFYECLEVL |
| 1052 | IGF1339 | AAANCHWPDEALQELCRYFA |
| 1053 | IGF1340 | TGICENPDEFYRQLCLLVE |
| 1054 | IGF1341 | WEHHCRRSHLDFYGCLSSI |
| 1055 | IGF1347 | AAGSPLDDCYGYTGFYQGMCLLEL |
| 1056 | IGF1348 | PSYHCSNMDYTFYECLMYL |
| 1057 | IGF1349 | EQSYCSQNDMFYDWFCALVS |
| 1058 | IGF1354 | GEEVCWVQEPFYSTLCILAF |
| 1059 | IGF1355 | NPFWCSWGHQFDNECDSMV |
| 1060 | IGF1356 | WASTCQQTFYSMNRCLSQW |

TABLE 12-continued

IGF1R binding MRDs

| SEQ ID: | Ref. No. | Peptide Sequence |
|---|---|---|
| 1061 | IGF1360 | LMELCAMDEDYYLWFCRAVE |
| 1062 | IGF1364 | SAVQCDLRLMCWQLRGPSRP |
| 1063 | IGF1365 | PSEICITEGLGFYQCLLKL |
| 1064 | IGF1366 | WVDKCHQEMMEFHECLKYV |
| 1065 | IGF1370 | ARCECWESQFYWDLCSLAL |
| 1066 | IGF1371 | CTATCLEDQGFYWNMCKLVF |
| 1067 | IGF1373 | AYDCRKHHMNFYECLTYL |
| 1068 | IGF1376 | VGQMCSMGLELDRMKCNPCY |
| 1069 | IGF1378 | LVDICQRQELDFYSCLRSV |
| 1070 | IGF1379 | TGSDCYFYKHLYSLCVEVE |
| 1071 | IGF1380 | ESGDCPWLGHVSFEECLMWL |
| 1072 | IGF1383 | LHSVCFEAPEWQQCLMQR |
| 1073 | IGF1386 | PGVSAHALCYEFPVLCFYDVG |
| 1074 | IGF1387 | AGVSADALCYEFPVLCFYDVG |
| 1075 | IGF1390 | DGESYFYVCLEHLLNVPGYHCVMTNG |
| 1076 | IGF1392 | SYGTRWNPSFESNQFHMKLCVLMDGK |
| 1077 | IGF1395 | PGVSADALCYEFPVLCFYDV |
| 1078 | IGF1396 | HALCYEFPVLCFYDV |
| 1079 | IGF1401 | TSRRCEEYQDPLKEVCRYFL |
| 1080 | IGF1405 | AHALCYEFPVLCFYDVG |
| 1081 | IGF1406 | AHALCYEFPVLCFYDV |
| 1082 | IGF1408 | DFYICLEHLLNVPGYHCVMTNG |
| 1083 | IGF1409 | DALCYEFPVLCFYDV |
| 1084 | IGF1411 | NLMECIIALDFNQGMQCLQAY |
| 1085 | IGF1413 | NLMECHALDFYQGMQCLQPYRHP |
| 1086 | IGF1414 | DLMECHGLDFYKGMECLQAYG |
| 1087 | IGF1421 | AHALCYEFPVLCFYDV |
| 1088 | IGF1422 | NLMECHALDFNQGMQCVQAY |
| 1089 | IGF1430 | AIIALCYEFPVLCFYDVG |
| 1090 | IGF1432 | AYVCSNLNHCPALDFNQGMQCLQAYG |
| 1091 | IGF1437 | VTEARTNDCNTTTFYHWFDCQLGTG |
| 1092 | IGF1443 | NLMHCHGLDFYQGMQCLQAY |
| 1093 | IGF1445 | EAECRYPDTDLMWLCTYFSG |
| 1094 | IGF1446 | DALCYEFPVLCFYDVG |
| 1095 | IGF1895 | MAVGCTWVESCHWA |
| 1096 | IGF1896 | ALPECQDLMFYECLFT |
| 1097 | IGF1897 | FYNTCQFVGMEFYQCLDW |
| 1098 | IGF1899 | SVLGCDDVGFYQCLEF |
| 1099 | IGF1900 | AARWCDMQQHSFYECLQV |
| 1100 | IGF1904 | EPRLCHNYPDFYQCMSF |
| 1101 | IGF1905 | ASQTCIGMDFYSGLECLLG |
| 1102 | IGF1906 | SNGSCHIVDFYGWFQCQTS |
| 1103 | IGF1987 | ALAECIFEPTFEDCMWIL |
| 1104 | IGF1988 | VDMQCQVHGMTFYECLMRL |
| 1105 | IGF1989 | TLPECLYAPTFEICVEYL |
| 1106 | IGF1990 | WEERCVDSDFYTQLCMLAW |
| 1107 | IGF1991 | GTVLCPEDMDFYECMTFI |
| 1108 | IGF1992 | REELCSVSPFDYHCRLFS |
| 1109 | IGF1993 | LSYTCQHFDLPWELCLSLH |
| 1110 | IGF1994 | VISECEGLTFYQCMASL |
| 1111 | IGF1995 | WEEWCVDSDFYTQLCMLAW |
| 1112 | IGF1996 | REPLCIQDDPIMYLHCYFSV |
| 1113 | IGF1997 | MSYTCEDFDLPWELCLSLH |
| 1114 | IGF1998 | DDLDCKCLTFYECMAAL |
| 1115 | IGF1999 | WSNVCQARNMAFQECLEYL |
| 1116 | IGF2000 | EDLGCLYLTFNQCMMWL |
| 1117 | IGF2001 | FAHECSFHKLNFYQCLSFE |
| 1118 | IGF2002 | LMDFCYVYPNICGCSN |
| 1119 | IGF2004 | SRFVCQHDWGFYECLSML |
| 1120 | IGF2005 | ASHICHLIPTIEQCLFSL |
| 1121 | IGF2006 | VISECEGLTFYECMAAL |
| 1122 | IGF2009 | VDMLCQVHGMTFYECLMLL |
| 1123 | IGF2010 | WEEWCVDSDFYTQLCLLAW |
| 1124 | IGF2011 | WDRWCVTEELPEQLCFLDG |
| 1125 | IGF2012 | MSYTCEDFDLPCELCLSLH |
| 1126 | IGF2013 | GLDSCQQAYFYQFFCEVFR |
| 1127 | IGF2014 | VDMQCQVHGMTFYQCLMRL |
| 1128 | IGF2015 | EDLGCMYLTFYECMIWL |
| 1129 | IGF2016 | VSALCEDLEFYECILAL |
| 1130 | IGF2017 | DVRECEGLTFYECMAAL |
| 1131 | IGF2019 | TAWCHAAGLTFTQCLLWL |
| 1132 | IGF2020 | CEEWCVDSDFYTQLCMLAW |
| 1133 | IGF2021 | GISECEGLTFYECMAAL |

TABLE 12-continued

IGF1R binding MRDs

| SEQ ID: | Ref. No. | Peptide Sequence |
|---|---|---|
| 1134 | IGF2022 | EYKVCTSNDTFHWGICALLK |
| 1135 | IGF2023 | EDLGCMYLTFDECMMWL |
| 1136 | IGF2025 | WKEWCVDSDFYTQLCMLAW |
| 1137 | IGF2026 | FGQLCDQQVETMIECFERL |
| 1138 | IGF2027 | DLFDCQGLTFYQCLAAL |
| 1139 | IGF2029 | LQQICDPEIIVTFYQCMTLL |
| 1140 | IGF2030 | QSLTCNDFTDWQSLCRC |
| 1141 | IGF2031 | PREACHDYDVVLHQLCMYFV |
| 1142 | IGF2033 | EDLGCVCLTFYECMIAL |
| 1143 | IGF2034 | IPGLCLE FPELCFHQW |
| 1144 | IGF2035 | LCWEGYKWFYDQIKPD |
| 1145 | IGF2036 | GFHHAYY KYRGQAGQGS ATGGSSRITP SDLCKEFPEL CF |
| 1146 | IGF2038 | RCLANSY HCSGQAGQGS ATGGSSRITP SDLCKEFPEL CF |
| 1147 | IGF2040 | GSYCAPDWHN CFGQAGQGSR ITPSDLCKEF PELCF |
| 1148 | IGF2041 | IPLLCLE FPVLCFENE |
| 1149 | IGF2042 | SLEHLCQTRDGFYELMCTLA L |
| 1150 | IGF2043 | SKDPVCKTKHQFYQMLCTLA F |

TABLE 13

IL6 binding MRDs

| SEQ ID: | Ref. No. | Peptide Sequence |
|---|---|---|
| 1158 | ILB59 | QRMEKFMHGS |
| 1159 | ILB60 | MLDWVGRRPF |
| 1160 | ILB65 | YFWHSLKTMM |
| 1161 | ILB69 | DEIPLWEFQF |
| 1162 | ILB71 | FQESWSTWVEGQAG |
| 1163 | ILB73 | VWTAFIQMNS |
| 1164 | ILB75 | ECTHPVFVRPCWGQAG |
| 1165 | ILB76 | MWMYGWWWAG |
| 1166 | ILB77 | FCIYYHNHMIWGQACQAGRCG SYCWWQDYAYKVGQAG |
| 1167 | ILB82 | ICVASICGLVC |
| 1168 | ILB84 | RWHYWHQHWWGQAG |
| 1169 | ILB87 | VCKWKQEYCKGQAG |
| 1170 | ILB88 | WYIIWMKEIIMWGQAG |

TABLE 13-continued

IL6 binding MRDs

| SEQ ID: | Ref. No. | Peptide Sequence |
|---|---|---|
| 1171 | ILB89 | HHHKMWPQNKSADSHAYTMM |
| 1172 | ILB91 | WPSWTYWYHF |
| 1173 | ILB92 | PWTYNWPWFM |
| 1174 | ILB94 | IWHVFYMVQAGQAG |
| 1175 | ILB96 | RYMHMVWQHI |
| 1176 | ILB98 | PMTMWWFFWKGQAG |
| 1177 | ILB99 | HSFVYMHWFL |
| 1178 | ILB100 | WPMITWLGWYGQAG |
| 1179 | ILB101 | YMFHWPLFWLGQAG |
| 1180 | ILB102 | MQGWLWAKWW |
| 1181 | ILB104 | IYAWWKWHWFGQAG |
| 1182 | ILB105 | TMQPHHIYGYGQAG |
| 1183 | ILB106 | SLFMPQHNVHGQAG |
| 1184 | ILB107 | YWPSLEWDWS |
| 1185 | ILB114 | GCWWVATECWGQAG |
| 1186 | ILB122 | GCTWLIDICTGQAG |
| 1187 | ILB128 | HQLQPYIQDL |
| 1188 | ILB130 | WCLAGHVYCQGQAG |
| 1189 | ILB135 | GVLKSGFRSLRCMARP |
| 1190 | ILB139 | PCPGFPPPMLCMGQAG |
| 1191 | ILB140 | PCMRDWWMCGGQAG |
| 1192 | ILB142 | KCTHLPFQRNCSGQAG |
| 1193 | ILB143 | FCHHWRPVCLGQAG |
| 1194 | ILB146 | ACMLKTHRCKGPGR |
| 1195 | ILB148 | RCSIWKVYAMCM |
| 1196 | ILB151 | ECLWTSLECEGQAG |
| 1197 | ILB158 | VCIPMATMCIGQAG |
| 1198 | ILB226 | SVSWCFWDPLVMQCKDHT |
| 1199 | ILB228 | VHFNCAWDPLMMRCNYDL |
| 1200 | ILB229 | RMSTCLWDPLLMNCKSLW |
| 1201 | ILB230 | TSEPCFWDPLLMTCDYGS |
| 1202 | ILB231 | QNVNCLWDPLRMNCVEYK |
| 1203 | ILB232 | SYIGYTYCPWDPLTMRCV |
| 1204 | ILB233 | LRHFVQYCPWDPLLMACI |
| 1205 | ILB234 | FTIGGPICGWDPLLMRCV |
| 1206 | ILB236 | LLCSENWCRWDPLMMSCR |
| 1207 | ILB237 | FSQMCGWDPLMMCRSVN |
| 1208 | ILB238 | VGSDCMWDPLMMNCRYSY |

TABLE 13-continued

IL6 binding MRDs

| SEQ ID: | Ref. No. | Peptide Sequence |
|---|---|---|
| 1209 | ILB239 | LSLLCHWDPLIMRCSYDS |
| 1210 | ILB240 | YIPPCHWDPLLMDCAQIQ |
| 1211 | ILB241 | MMMECHWDPLLMRCQNPK |
| 1212 | ILB242 | LPSSCYWDPLLMECSHRN |
| 1213 | ILB243 | LVPPLFACFWDPLLMNCS |
| 1214 | ILB244 | WSYFNRSCAWDPLLMKCA |
| 1215 | ILB245 | SSFTVVSCMWDPLLMSCM |
| 1216 | ILB246 | LLTKYRTCHWDPLLMLCR |
| 1217 | ILB247 | MVFWDEFCSWDPLLMACR |
| 1218 | ILB248 | NQLSSIMCHWDPLLMTCQ |
| 1219 | ILB249 | TFTSCSWDPLLMDCTDFV |
| 1220 | ILB250 | MVFYCYWDPLLMLCHDQT |
| 1221 | ILB252 | QVSLCFWDPLMMTCSVPF |
| 1222 | ILB253 | ISMPCSWDPLLMNCAKWP |
| 1223 | ILB254 | FEAWCVWDPLLMNCVTYT |
| 1224 | ILB255 | NRYERFMCFWDPLLMMCS |
| 1225 | ILB256 | VIMNQFFCFWDPLLMRCM |
| 1226 | ILB257 | FSSAYSGCYWDPLLMECI |
| 1227 | ILB258 | WSSGLYGCYWDPLLMLCK |
| 1228 | ILB259 | RSSADWSCLWDPLLMQCM |
| 1229 | ILB260 | ITSLERSCMWDPLLMLCS |
| 1230 | ILB261 | MHGYCTWDPLLMRCSNYI |
| 1231 | ILB262 | STVGCFWDPLLMDCRSMV |
| 1232 | ILB263 | WLSTCLWDPLLMQCIESE |
| 1233 | ILB264 | SGVSCFWDPLRMICYILP |
| 1234 | ILB265 | YLSSCLWDPLLMRCTKLM |
| 1235 | ILB266 | APQQCNWDPLLMNCVKYV |
| 1236 | ILB267 | SYVTFLSCHWDPLRMQCI |
| 1237 | ILB268 | FSSVTSACAWDPLIMRCI |
| 1238 | ILB269 | ALALVASVTGTRYQCRV |
| 1239 | ILB270 | TKNVTYECMWDPLLMVCT |
| 1240 | ILB271 | PFYEYTCCPWDPLLMNCL |
| 1241 | ILB272 | KDYFHQYCIWDPLTMNCA |
| 1242 | ILB273 | HYTNCVWDPLLMRCYEFA |
| 1243 | ILB274 | AVGWCPWDPLLMNCMGRN |
| 1244 | ILB275 | VASVCLWDPLLMQCWSHY |
| 1245 | ILB276 | DGMICLWDPIRMDCYYTE |
| 1246 | ILB277 | DFTFCAWDPLLMACNDQF |
| 1247 | ILB278 | DWEECVWDPLLMMCGISY |
| 1248 | ILB279 | QRNYSEECHWDPLLMLCQ |
| 1249 | ILB280 | ALVNRVECSWDPLLMKCS |
| 1250 | ILB281 | NLDVTPYCYWDPLRMVCY |
| 1251 | ILB282 | PRFLIYFCNWDPLLMMCK |
| 1252 | ILB283 | YYPITLDCIIWDPLLMRCL |
| 1253 | ILB284 | YIEINHPCHWDPLLMDCT |
| 1254 | ILB285 | LVDVCSWDPLLMNCRLAN |
| 1255 | ILB286 | FDTFCFWDPLLMDCAAPT |
| 1256 | ILB287 | QSNDCAWDPLLMQCLNSL |
| 1257 | ILB288 | MTSHCLWDPLLMVCVNHE |
| 1258 | ILB289 | HFTFCAWDPLLMQCGIDS |
| 1259 | ILB290 | KSTALITCIWDPLLMQCR |
| 1260 | ILB291 | YTNNMETCAWDPLLMMCY |
| 1261 | ILB292 | FSGKQMMCAWDPLMMQCA |
| 1262 | ILB293 | LHLGEWDCYWDPLLMICR |
| 1263 | ILB294 | WLFNGVDCLWDPLLMDCI |
| 1264 | ILB295 | FHESLLPCFWDPLLMTCQ |
| 1265 | ILB296 | LYMICTWDPLLMDCREDR |
| 1266 | ILB297 | LNLLCAWDPLLMSCIETL |
| 1267 | ILB298 | WEHGCMWDPLLMQCINRS |
| 1268 | ILB299 | GSTCCVWDPLLMKCMSPV |
| 1269 | ILB300 | GLYNCTWDPLLMRCSESI |
| 1270 | ILB302 | DNWSISSCYWDPLLMNCP |
| 1271 | ILB303 | WFLFPWTCPWDPLLMECI |
| 1272 | ILB304 | SVQYETPCYWDPLRMQCQ |
| 1273 | ILB305 | LDFSFFDCSWDPLLMRCS |
| 1274 | ILB306 | FRMKKVDCCWDPLLMNCR |
| 1275 | ILB307 | NAPVWVECMWDPLLMSCV |
| 1276 | ILB308 | GYAWCFWDPLLMKCTWQV |
| 1277 | ILB309 | DDFLCSWDPLLMDCMVYP |
| 1278 | ILB310 | FEDSCAWDPLLMACSNPI |
| 1279 | ILB311 | LAGSVSGTLLQQTVQRT |
| 1280 | ILB312 | LVSFCAWDPLLMNCMWPM |
| 1281 | ILB313 | LYGECAWDPLLMRCQPYY |
| 1282 | ILB314 | GSKRFGICFWDPLLMDCA |
| 1283 | ILB315 | YVAVGPSCLWDPLLMMCA |

TABLE 13-continued

IL6 binding MRDs

| SEQ ID: | Ref. No. | Peptide Sequence |
|---|---|---|
| 1284 | ILB316 | GFGSSWFCSWDPLLMQCQ |
| 1285 | ILB317 | SISRAFSCVWDPLLMNCS |
| 1286 | ILB319 | MTQSLSFCHWDPLLMYCV |
| 1287 | ILB320 | LVPYSWYCVWDPLLMDCV |
| 1288 | ILB321 | SDNLYFDCHWDPLLMMCR |
| 1289 | ILB323 | LFTMCHWDPLLMDCATVP |
| 1290 | ILB324 | FCSWDPMLMDCSTITFDM |
| 1291 | ILB329 | TQMYCWWDPLLMNCTEMS |
| 1292 | ILB330 | LTGYCYWDPLLMNCLEQG |
| 1293 | ILB331 | NHPMCWWDPLMMDCMYFE |
| 1294 | ILB332 | PDTLCIWDPLLMQCRWMP |
| 1295 | ILB333 | VNVSFWGCVWDPLLMVCS |
| 1296 | ILB334 | KAVLSNYCYWDPLLMICS |
| 1297 | ILB335 | LGRLVPYCRWDPLSMVCL |
| 1298 | ILB337 | RWKIDVICKVEILQRRCT |
| 1299 | ILB339 | SHIACGWDPLMMMCTQEM |
| 1300 | ILB340 | ICWWDPLLMDCISTVEPY |
| 1301 | ILB341 | MFLSVVDCFWDPLLMECV |
| 1302 | ILB342 | HCYWDPLLMTCYDSGPWV |
| 1303 | ILB343 | IFEYCVWDPLLLRCSLNS |
| 1304 | ILB344 | FVDDCVWDPLMMDCHRYS |
| 1305 | ILB347 | KLALLDDCIWDPLLMSCR |
| 1306 | ILB348 | WTNWCGWVLPTMLCMYWI |
| 1307 | ILB349 | DWSTLYFCSWDPLLMLCS |
| 1308 | ILB350 | GQNHCFWDPLMMICLNGH |
| 1309 | ILB351 | TLLTCVWDPLLMQCRDLE |
| 1310 | ILB352 | YVSPCVWDPLLMLCNESW |
| 1311 | ILB353 | LCFWDPLYMECSTHLYID |
| 1312 | ILB357 | LLAWCFWDPLLMDCVWDS |
| 1313 | ILB358 | YHYLSVNCHWDPLLMECT |
| 1314 | ILB359 | FHHFCFWDPLLMGCMNYN |
| 1315 | ILB360 | FCVWDPLLMLCQWLEDSS |
| 1316 | ILB361 | FNTQSTDCWWDPLLMLCA |
| 1317 | ILB362 | VQLTCFWDPLMMWCSEQS |
| 1318 | ILB365 | LRAICIWDPLMMLCGTMG |
| 1319 | ILB367 | ISFPHFICPWDPLLMQCS |
| 1320 | ILB368 | RSFVCNWDPLMMTCTSDL |
| 1321 | ILB369 | PLWSCFWDPLLMDCQWTL |
| 1322 | ILB370 | SHSSNMGCYWDPLMMMCH |
| 1323 | ILB371 | RVYECYWDPLIMDCTWDL |
| 1324 | ILB377 | FSVNYTPCVWDPLLMRCS |
| 1325 | ILB378 | LVALPNSCFWDPLLMTCR |
| 1326 | ILB379 | FWVGCPWDPLLMKCTSYN |
| 1327 | ILB380 | KLALMSSCLWDPLLMDCM |
| 1328 | ILB381 | HCYWDPLLMDCKYLILEG |
| 1329 | ILB382 | GSIICWWDPLLMSCADLK |
| 1330 | ILB383 | QLFTCIIWDPLLMDCTWDS |
| 1331 | ILB387 | WLEQCVWDPLLMSCTSYV |
| 1332 | ILB388 | SSPGIDACWWDPLLMDCA |
| 1333 | ILB389 | LHFVCFWDPLIMDCSPQM |
| 1334 | ILB390 | SYAYCYWDPLLMECADPM |
| 1335 | ILB393 | VWLVFWPCFLDPISSICN |
| 1336 | ILB395 | SLLECFWDPLMMNCSNGL |
| 1337 | ILB397 | SDDWTMECYWDPLLMTCI |
| 1338 | ILB398 | ALMFCFWDPLLMRCNANV |
| 1339 | ILB399 | NRLMCFWDPLLMVCQSDL |
| 1340 | ILB402 | LMQRPVHCVWDPLLMNCR |
| 1341 | ILB403 | WQCYYRLCMGYPLGILCS |
| 1342 | ILB404 | FRFATFFCYWDPLLMSCR |
| 1343 | ILB405 | LTFLFYRCSWESVTPGCI |
| 1344 | ILB406 | LLLSTYWCSWDPLLMDCN |
| 1345 | ILB407 | SLWLTVLCPWDPLLMACI |
| 1346 | ILB408 | TSGLCVWDPLMMSCASLL |
| 1347 | ILB409 | LIMGCPWDPLLMLCQERR |
| 1348 | ILB410 | SNPICIWDPLLMRCIWYQ |
| 1349 | ILB412 | QSFLMRGCAWDPLLMQCI |
| 1350 | ILB414 | LVVNCPWDPLLMACAVNV |
| 1351 | ILB418 | STRDCYWDPLLMTCINYI |
| 1352 | ILB419 | SYQVCCWDPLLMTCQRAR |
| 1353 | ILB421 | YHWQLNGCVWHPLMINCL |
| 1354 | ILB423 | LCLWDALLMECRIHSFDS |
| 1355 | ILB425 | FCVWDPLLMIICRFTIIDRM |
| 1356 | ILB426 | SMTMCGWNPLGMWCHSLG |
| 1357 | ILB428 | TLVSLGLCAWDPLLMSCA |
| 1358 | ILB429 | SFLFYSSCVWDPLLMQCG |

TABLE 13-continued

IL6 binding MRDs

| SEQ ID: | Ref. No. | Peptide Sequence |
|---|---|---|
| 1359 | ILB430 | TLDNCAWDPLLMRCWGQW |
| 1360 | ILB431 | SSIYCLWDPLLMRCATPL |
| 1361 | ILB432 | RCPWDPLMMMCIEEMYTD |
| 1362 | ILB436 | LCSWDPLLMMRCVVMDSLD |
| 1363 | ILB437 | FFCLWHFCTGDPLKIHCM |
| 1364 | ILB439 | QLFLTLNCSWDPLLMQCL |
| 1365 | ILB440 | SYLGGLACAWDPLLMQCI |
| 1366 | ILB441 | GFPECFWDPLLMDCTYWF |
| 1367 | ILB445 | VFPWCYWDPLLMMDCAIQN |
| 1368 | ILB450 | FCVWDPLLMDCSGNTFYF |
| 1369 | ILB451 | TCAWDPLLMVCRYPCPAF |
| 1370 | ILB452 | AALECPWDPLMMSCIKTS |
| 1371 | ILB453 | YLPSWLSCSWDPLLMICS |
| 1372 | ILB454 | HLSLLMDCCWDPLTMQCT |
| 1373 | ILB455 | RWPFCHWDPLLMMCSVSY |
| 1374 | ILB457 | LPLLRFPCDGKQLWKFCL |
| 1375 | ILB461 | QVSYCPWDPLLMQCQLSG |
| 1376 | ILB463 | RSIECFWDPLMMECMGYV |
| 1377 | ILB464 | LGMTFYVCPWDPLLMLCI |
| 1378 | ILB465 | YYYSWPMCYWDPHMLFCL |
| 1379 | ILB467 | PCYWDPLLMRCMLQVDNW |
| 1380 | ILB469 | FFSDCNWDPLLMHCANKL |
| 1381 | ILB470 | RPSLVPICYWDPLLMICI |
| 1382 | ILB471 | NYFNCVWDPLRMDCQYFM |
| 1383 | ILB473 | DWQYYSSKTYGQAGQGSATGGSSFNEDCMWDPLLMDCAYSP |
| 1384 | ILB474 | PDWITWQPAWGQAGQGSFNEDCMWDPLLMDCAYSP |
| 1385 | ILB475 | NMYHEHAAWGQAGQGSATGGSSFNEDCMWDPLLMDCAYSP |
| 1386 | ILB476 | EVNHVEDFPAGQAGQGSFNEDCMWDPLLMDCAYSP |
| 1387 | ILB477 | WYTHSLQMWGQAGQGSATGGSSFNEDCMWDPLLMDCAYSP |
| 1388 | ILB478 | GPDVTQYVKFGQAGQGSFNEDCMWDPLLMDCAYSP |
| 1389 | ILB479 | QSPSASHIMGQAGQGSFNEDCMWDPLLMDCAYSP |
| 1390 | ILB480 | GPVEESAPQYGQAGQGSATGGSSFNEDCMWDPLLMDCAYSP |
| 1391 | ILB481 | WIMSLSWPMAGQAGQGSATGGSGSTASSFNEDCMWDPLLMDCAYSP |
| 1392 | ILB482 | HVGWHAMNPWGQAGQGSFNEDCMWDPLLMDCAYSP |
| 1393 | ILB483 | VWTAFIQMNSGQAGQGSATGGSSFNEDCMWDPLLMDCAYSP |
| 1394 | ILB485 | PDWITWQPAWGQAGQGSATGGSSFNEDCMWDPLLMDCAYSP |
| 1395 | ILB486 | VMWQWEEGHWGQAGQGSFNEDCMWDPLLMDCAYSP |
| 1396 | ILB487 | TQEMWFTGINGQAGQGSATGGSSFNEDCMWDPLLMDCAYSP |
| 1397 | ILB488 | DNWWRIWDKQGQAGQGSFNEDCMWDPLLMDCAYSP |
| 1398 | ILB489 | VTWFMYQDRAGQAGQGSFNEDCMWDPLLMDCAYSP |
| 1399 | ILB490 | LPPPCYWTTWGKECQMFD |
| 1400 | ILB491 | VEPIPYTMMRGQAGQGSFNEDCMWDPLLMDCAYSP |
| 1401 | ILB492 | RIVVMEQMQIGQAGQGSATGGSSFNEDCMWDPLLMDCAYSP |
| 1402 | ILB493 | MCNPMESECHGQAGQGSATGGSSFNEDCMWDPLLMDCAYSP |
| 1403 | ILB494 | VYWYDVKWTWGQAGQGSFNEDCMWDPLLMDCAYSP |
| 1404 | ILB495 | DCEQNQTYCVGQAGQGSFNEDCMWDPLLMDCAYSP |
| 1405 | ILB497 | WWPNYTWDHPQGSATGGSSFNEDCMWDPLLMDCAYSP |
| 1406 | ILB498 | DGSPGYRAYIISQFGQAGQGSATGGSGSTASSGSGSSFNEDCMWDPLLMDCAYSP |
| 1407 | ILB499 | WPWFEQEHFWGQAGQGSFNEDCMWDPLLMDCAYSP |
| 1408 | ILB500 | WCRPTDLKLVKGQAGQGSFNEDCMWDPLLMDCAYSP |
| 1409 | ILB501 | DKSGGLVAIQGQAGQGSFNEDCMWDPLLMDCAYSP |
| 1410 | ILB502 | DRWGWQKEPSGQAGQGSFNEDCMWDPLLMDCAYSP |
| 1411 | ILB503 | LAWKQSWIDTGQAGQGSATGGSGSTASSGSGSSFNEDCMWDPLLMDCAYSP |
| 1412 | ILB504 | VMLEQMPMMRGQAGQGSATGGSSFNEDCMWDPLLMDCAYSP |
| 1413 | ILB505 | ATRMWPMSISGQAGQGSATGGSSFNEDCMWDPLLMDCAYSP |
| 1414 | ILB506 | MYVMKWQNWTGQAGQGSFNEDCMWDPLLMDCAYSP |

TABLE 13-continued

IL6 binding MRDs

| SEQ ID: | Ref. No. | Peptide Sequence |
|---|---|---|
| 1415 | ILB508 | ISDVYQWHSYGQAGQGSFNED CMWDPLLMDCAYSP |
| 1416 | ILB509 | MVKLWEIYSWGQAGQGSFNED CMWDPLLMDCAYSP |
| 1417 | ILB511 | QWGWSMWQEVGQAGQGSFNE DCMWDPLLMDCAYSP |
| 1418 | ILB512 | MWSAVFQPYQGQAGQGSATG GGSSFNEDCMWDPLLMDCAYSP |
| 1419 | ILB513 | AMHNVMWRAMGQAGQGSFNE DCMWDPLLMDCAYSP |
| 1420 | ILB514 | HEDKFIVWMGQAGQGSATG GSSFNEDCMWDPLLMDCAYSP |
| 1421 | ILB516 | QWWWTNSPWLGQAGQGSATG GSSFNEDCMWDPLLMDCAYSP |
| 1422 | ILB517 | QHQTAFTEMVGQAGQGSFNED CMWDPLLMDCAYSP |
| 1423 | ILB518 | QTMWTRWMHDGQAGQGSFNE DCMWDPLLMDCAYSP |
| 1424 | ILB519 | YAWHHHVLNTGQAGQGSFNED CMWDPLLMDCAYSP |
| 1425 | ILB520 | YCPFMPALCVGQAGQGSATGG SGSTASSGSGSSFNEDCMWDPL LMDCAYSP |
| 1426 | ILB522 | RTYSTPYWGWGQAGQGSFNED CMWDPLLMDCAYSP |
| 1427 | ILB523 | EIFWWLLQWEGQAGQGSATGG SSFNEDCMWDPLLMDCAYSP |
| 1428 | ILB524 | QIDFKYMMWTGQAGQGSATG GSSFNEDCMWDPLLMDCAYSP |
| 1429 | ILB525 | QMQWLDDEFYGQAGQGSATG GSSFNEDCMWDPLLMDCAYSP |
| 1430 | ILB526 | PVQQEWMQWYGQAGQGSFNE DCMWDPLLMDCAYSP |
| 1431 | ILB527 | QAWKLMWFAWGQAGQGSATG GSSFNEDCMWDPLLMDCAYSP |
| 1432 | ILB528 | MPSTQINQWVGQAGQGSFNED CMWDPLLMDCAYSP |
| 1433 | ILB529 | TEKDPAQDWWGQAGQGSATG GSSFNEDCMWDPLLMDCAYSP |
| 1434 | ILB531 | EYTNTSWKGIIGQAGQGSATGG SSFNEDCMWDPLLMDCAYSP |
| 1435 | ILB532 | QMEVAHVVDLGQAGQGSATG GSSFNEDCMWDPLLMDCAYSP |
| 1436 | ILB533 | IKPSSHWWWQGQAGQGSATGG SSFNEDCMWDPLLMDCAYSP |
| 1437 | ILB534 | YEEQQVDEFGGQAGQGSATGG SGSTASSFNEDCMWDPLLMDC AYSP |
| 1438 | ILB535 | AWWQGQRPYNGQAGQGSFNE DCMWDPLLMDCAYSP |
| 1439 | ILB536 | PPLWMSQMVPQGSATGGSSFN EDCMWDPLLMDCAYSP |
| 1440 | ILB537 | VEHLSHSYVLGQAGQGSATGG SSFNEDCMWDPLLMDCAYSP |
| 1441 | ILB538 | DCSPDVHDCHGQAGQGSATGG SSFNEDCMWDPLLMDCAYSP |
| 1442 | ILB539 | TYLQLWYFIQGQAGQGSFNEDC MWDPLLMDCAYSP |
| 1443 | ILB540 | GRWWMVQWVEGQAGQGSFNE DCMWDPLLMDCAYSP |
| 1444 | ILB541 | VMEGHQFAQFGQAGQGSFNED CMWDPLLMDCAYSP |
| 1445 | ILB542 | WWSPSYAWVMGQAGQGSFNE DCMWDPLLMDCAYSP |
| 1446 | ILB543 | MEMVSAAWQEGQAGQGSFNE DCMWDPLLMDCAYSP |
| 1447 | ILB544 | YWWTIDYWPYGQAGQGSATG GSSFNEDCMWDPLLMDCAYSP |
| 1448 | ILB545 | YPMYYYQDISGQAGQGSFNED CMWDPLLMDCAYSP |
| 1449 | ILB546 | IMWAGPIFPNGQAGQGSFNEDC MWDPLLMDCAYSP |
| 1450 | ILB547 | IMGMYEGFRTGQAGQGSFNED CMWDPLLMDCAYSP |
| 1451 | ILB548 | IERAYIISTRWGQAGQGSATGG SSFNEDCMWDPLLMDCAYSP |
| 1452 | ILB549 | ETELKKPAMQGQAGQGSFNED CMWDPLLMDCAYSP |
| 1453 | ILB550 | QDWHYPWVYQGQAGQGSFNE DCMWDPLLMDCAYSP |
| 1454 | ILB551 | PLQKWEHIVNGQAGQGSFNED CMWDPLLMDCAYSP |
| 1455 | ILB552 | TDSWCHTLYWALQHCVAQE |
| 1456 | ILB553 | WQNPWPVRFWGQAGQGSATG GSGSTASSFNEDCMWDPLLMD CAYSP |
| 1457 | ILB554 | APGVAMWMFIGQAGQGSFNED CMWDPLLMDCAYSP |
| 1458 | ILB555 | QSNGAHAWVWGQAGQGSATG GSGSTASSFNEDCMWDPLLMD CAYSP |
| 1459 | ILB556 | PDSSCHTLYWQLHHCARRE |
| 1460 | ILB557 | KWNQQWTIARGQAGQGSFNED CMWDPLLMDCAYSP |
| 1461 | ILB558 | ECSCAKSRYANGQAGQGSFNE DCMWDPLLMDCAYSP |
| 1462 | ILB559 | SCQFLEEYKDCRGQAGQGSAT GGSSFNEDCMWDPLLMDCAYSP |
| 1463 | ILB560 | VPSLIYHTYYGQAGQGSATGGS SFNEDCMWDPLLMDCAYSP |

TABLE 13-continued

IL6 binding MRDs

| SEQ ID: | Ref. No. | Peptide Sequence |
|---|---|---|
| 1464 | ILB561 | SIYISYRQNHGQAGQGSATGGSGSTASSFNEDCMWDPLLMDCAYSP |
| 1465 | ILB562 | TYYTHTAWDRGQAGQGSFNEDCMWDPLLMDCAYSP |
| 1466 | ILB563 | LLVEFFKIITYGQAGQGSFNEDCMWDPLLMDCAYSP |
| 1467 | ILB564 | FQGHWHIKKQGQAGQGSATGGSGSTASSGSGSSFNEDCMWDPLLMDCAYSP |
| 1468 | ILB565 | FHLPIHWHYQGQAGQGSATGGSSFNEDCMWDPLLMDCAYSP |
| 1469 | ILB566 | LIVLQPKNMVGQAGQGSFNEDCMWDPLLMDCAYSP |
| 1470 | ILB567 | TYSWRDWGMYGQAGQGSFNEDCMWDPLLMDCAYSP |
| 1471 | ILB568 | DGSHPIVVVTEWFGQAGQGSFNEDCMWDPLLMDCAYSP |
| 1472 | ILB569 | VYWQAMNQDYGQAGQGSFNEDCMWDPLLMDCAYSP |
| 1473 | ILB570 | PDSWCHTLYWDLLYCVNQE |
| 1474 | ILB572 | DCAMWFMFKDQGQAGQGSATGGSSFNEDCMWDPLLMDCAYSP |
| 1475 | ILB573 | NNMHPLWPISGQAGQGSATGGSSFNEDCMWDPLLMDCAYSP |
| 1476 | ILB574 | FWYSWNPQWDGQAGQGSFNEDCMWDPLLMDCAYSP |
| 1477 | ILB576 | EGYWRGPHWEGQAGQGSFNEDCMWDPLLMDCAYSP |
| 1478 | ILB577 | YRMKWDFMLHGQAGQGSFNEDCMWDPLLMDCAYSP |
| 1479 | ILB578 | WWWDQHMLENGQAGQGSATGGSGSTASSFNEDCMWDPLLMDCAYSP |
| 1480 | ILB579 | PCHWAQQPCAGQAGQGSFNEDCMWDPLLMDCAYSP |
| 1481 | ILB580 | FFDFFSFSNSGQAGQGSATGGSSFNEDCMWDPLLMDCAYSP |
| 1482 | ILB581 | VWTAFIQMNSGQAGQGSFNEDCMWDPLLMDCAYSP |
| 1483 | ILB582 | QIQQFSFWVGQAGQGSFNEDCMWDPLLMDCAYSP |
| 1484 | ILB583 | LFIPYMAQIWGQAGQGSFNEDCMWDPLLMDCAYSP |
| 1485 | ILB584 | MTTMYHIIVLGQAGQGSATGGSGSTASSFNEDCMWDPLLMDCAYSP |
| 1486 | ILB585 | GCSMCHMMMVKWHRGQAGQGSFNEDCMWDPLLMDCAYSP |
| 1487 | ILB586 | EQHVDWYWVPQGSFNEDCMWDPLLMDCAYSP |
| 1488 | ILB587 | NQTQPKRPTDGQAGQGSFNEDCMWDPLLMDCAYSP |
| 1489 | ILB588 | ELGGRKSMLIGQAGQGSFNEDCMWDPLLMDCAYSP |
| 1490 | ILB589 | EAWRELRWWNGQAGQGSFNEDCMWDPLLMDCAYSP |
| 1491 | ILB590 | YCTDRVDICMGQAGQGSATGGSGSTASSFNEDCMWDPLLMDCAYSP |
| 1492 | ILB591 | LIVPAPLTWWGQAGQGSFNEDCMWDPLLMDCAYSP |
| 1493 | ILB592 | WVPDMWMHEWGQAGQGSFNEDCMWDPLLMDCAYSP |
| 1494 | ILB593 | YQDSWITGMQGQAGQGSATGGSSFNEDCMWDPLLMDCAYSP |
| 1495 | ILB594 | YEEIICRLFPADWICSLLQ |
| 1496 | ILB595 | VCQDEVYMWCEGQAGQGSATGGSSFNEDCMWDPLLMDCAYSP |
| 1497 | ILB596 | ADSWCHTLYWNLRHCEIQE |
| 1498 | ILB597 | HHQQSMYWLEGQAGQGSATGGSSFNEDCMWDPLLMDCAYSP |
| 1499 | ILB598 | AEIITFALQYVGQAGQGSFNEDCMWDPLLMDCAYSP |
| 1500 | ILB599 | YTTYNWKPWQGQAGQGSATGGSSFNEDCMWDPLLMDCAYSP |
| 1501 | ILB600 | ACDTQHHGCMGQAGQGSATGGSGSTASSFNEDCMWDPLLMDCAYSP |
| 1502 | ILB601 | EVVGVGWFLNGQAGQGSFNEDCMWDPLLMDCAYSP |
| 1503 | ILB602 | PESWCHTLYWNLQHCLSQE |
| 1504 | ILB603 | IDNKYEGMVLGQAGQGSFNEDCMWDPLLMDCAYSP |
| 1505 | ILB604 | HWMTYQFWIQGQAGQGSATGGSSFNEDCMWDPLLMDCAYSP |
| 1506 | ILB605 | TCELMQAWTHLGQAGQGSATGGSSFNEDCMWDPLLMDCAYSP |
| 1507 | ILB606 | YYPQHIDHIMGQAGQGSATGGSSFNEDCMWDPLLMDCAYSP |
| 1508 | ILB607 | MPLDDQPFLEGQAGQGSFNEDCMWDPLLMDCAYSP |
| 1509 | ILB608 | HTEFQRLEWPQGSATGGSSFNEDCMWDPLLMDCAYSP |
| 1510 | ILB609 | IQWPSMMEIHGQAGQGSFNEDCMWDPLLMDCAYSP |
| 1511 | ILB610 | QTGWGPKYMWGQAGQGSFNEDCMWDPLLMDCAYSP |
| 1512 | ILB611 | QSHIHLEKWLGQAGQGSFNEDCMWDPLLMDCAYSP |

TABLE 13-continued

IL6 binding MRDs

| SEQ ID: | Ref. No. | Peptide Sequence |
|---|---|---|
| 1513 | ILB612 | QCWIYPYDGLCNGQAGQGSATGGSSFNEDCMWDPLLMDCAYSP |
| 1514 | ILB613 | TCTHLVKTVLIGQAGQGSFNEDCMWDPLLMDCAYSP |
| 1515 | ILB614 | PLYTVWKWSGGQAGQGSATGGSGSTASSFNEDCMWDPLLMDCAYSP |
| 1516 | ILB615 | FNFERWEQKPQGSFNEDCMWDPLLMDCAYSP |
| 1517 | ILB616 | YVLQQVEMQEGQAGQGSFNEDCMWDPLLMDCAYSP |
| 1518 | ILB617 | SMTKYKALYHGQAGQGSFNEDCMWDPLLMDCAYSP |
| 1519 | ILB618 | QDNIAYQGWWGQAGQGSFNEDCMWDPLLMDCAYSP |
| 1520 | ILB619 | MDHIWQHGQLGQAGQGSATGGSSFNEDCMWDPLLMDCAYSP |
| 1521 | ILB620 | SCFGDLQICWGQAGQGSATGGSGSTASSGSGSSFNEDCMWDPLLMDCAYSP |
| 1522 | ILB621 | HCKDMHWAIQFGQAGQGSFNEDCMWDPLLMDCAYSP |
| 1523 | ILB622 | WLFVAEQSQYGQAGQGSATGGSSFNEDCMWDPLLMDCAYSP |
| 1524 | ILB623 | ANSWCIITLYWDLMYCVWQE |
| 1525 | ILB624 | DGSGFYPNKWFHGGQAGQGSATGGSSFNEDCMWDPLLMDCAYSP |
| 1526 | ILB625 | MVYRWVMQADGQAGQGSATGGSGSTASSGSGSSFNEDCMWDPLLMDCAYSP |
| 1527 | ILB627 | HPMEIKTMMKGQAGQGSFNEDCMWDPLLMDCAYSP |
| 1528 | ILB629 | LQAWMWQVNQGQAGQGSATGGSSFNEDCMWDPLLMDCAYSP |
| 1529 | ILB630 | GCNYFPTQWECYGQAGQGSFNEDCMWDPLLMDCAYSP |
| 1530 | ILB631 | LQAWMWQVNQGQAGQGSATGGSSFNEDCMWDPLLMDCAYSPQGSATGGSSFNEDCMWDPLLMDCAYSP |
| 1531 | ILB632 | QFPYESPPSIGQAGQGSFNEDCMWDPLLMDCAYSP |
| 1532 | ILB633 | IYLSWDMPALGQAGQGSATGGSGSTASSFNEDCMWDPLLMDCAYSP |
| 1533 | ILB634 | QYTEMVALVYGQAGQGSATGGSGSTASSFNEDCMWDPLLMDCAYSP |
| 1534 | ILB635 | PDSWCHTLYWHLQHCLSQE |
| 1535 | ILB636 | PAKDPFVMRHGQAGQGSATGGSSFNEDCMWDPLLMDCAYSP |
| 1536 | ILB637 | WQVSSVQLPYGQAGQGSATGGSSFNEDCMWDPLLMDCAYSP |
| 1537 | ILB638 | QQTQTYWGTWGQAGQGSFNEDCMWDPLLMDCAYSP |
| 1538 | ILB639 | DQLWRQNWMQGQAGQGSFNEDCMWDPLLMDCAYSP |
| 1539 | ILB640 | QYYNVYWQNQGQAGQGSATGGSSFNEDCMWDPLLMDCAYSP |
| 1540 | ILB641 | QTYSNKPMGPQGSFNEDCMWDPLLMDCAYSP |
| 1541 | ILB642 | EEEWSWYDRRGQAGQGSFNEDCMWDPLLMDCAYSP |
| 1542 | ILB643 | AYYWKEWMKMGQAGQGSATGGSSFNEDCMWDPLLMDCAYSPG |
| 1543 | ILB644 | AIAHLDVFPPQGSFNEDCMWDPLLMDCAYSP |
| 1544 | ILB645 | QYQSRQTFQIGQAGQGSFNEDCMWDPLLMDCAYSPQGSFNEDCMWDPLLMDCAYSP |
| 1545 | ILB646 | YWAWQQEFQWGQAGQGSATGGSSFNEDCMWDPLLMDCAYSPGSYWAWQQEFQWGQAGQGSATGGSSFNEDCMWDPLLMDCAYSP |
| 1546 | ILB647 | YYQGFPWFQIGQAGQGSATGGSSFNEDCMWDPLLMDCAYSP |
| 1547 | ILB648 | FFYQWSYGWSGQAGQGSFNEDCMWDPLLMDCAYSP |
| 1548 | ILB649 | YEEIICALFPTDWICTLII |
| 1549 | ILB650 | WRWHAEWDWYGQAGQGSATGGSSFNEDCMWDPLLMDCAYSP |
| 1550 | ILB652 | WRWEFGYYYHGQAGQGSATGGSSFNEDCMWDPLLMDCAYSP |
| 1551 | ILB653 | MFYEYQWWIHGQAGQGSFNEDCMWDPLLMDCAYSP |
| 1552 | ILB654 | PDWITWQPAWGQAGQGSATGGSSFNEDCMWDPLLMDCAYSPQGSATGGSSFNEDCMWDPLLMDCAYSP |
| 1553 | ILB655 | WPFYEYIIHMGQAGQGSATGGSSFNEDCMWDPLLMDCAYSP |
| 1554 | ILB656 | RPYYYQWHIWGQAGQGSATGGSSFNEDCMWDPLLMDCAYSP |
| 1555 | ILB657 | TGFFWSWSFGGQAGQGSATGGSSFNEDCMWDPLLMDCAYSP |
| 1556 | ILB659 | SKMEQYPWNMGQAGQGSATGGSSFNEDCMWDPLLMDCAYSPQGSATGGSSFNEDCMWDPLLMDCAYSP |
| 1557 | ILB660 | YHWQQQHQYHGQAGQGSATGGSSFNEDCMWDPLLMDCAYSPQGSATGGSSFNEDCMWDPLLMDCAYSP |

TABLE 13-continued

IL6 binding MRDs

| SEQ ID: | Ref. No. | Peptide Sequence |
|---|---|---|
| 1558 | ILB661 | DWQVYYKTWIGQAGQGSATGGSGSTASSGSGSSFNEDCMWDPLLMDCAYSPQGSATGGSGSTASSGSGSSFNEDCMWDPLLMDCAYSP |
| 1559 | ILB662 | YRYTTYWWYSGQAGQGSATGGSGSTASSFNEDCMWDPLLMDCAYSP |
| 1560 | ILB664 | QCCMSQVSWYVGQAGQGSATGGSSFNEDCMWDPLLMDCAYSPQGSATGGSSFNEDCMWDPLLMDCAYSPQGSATGGSSFNEDCMWDPLLMDCAYSP |
| 1561 | ILB665 | YYQGFPWFQIGQAGQGSATGGSSFNEDCMWDPLLMDCAYSPGGGSYYQGFPWFQIGQAGQGSATGGSSFNEDCMWDPLLMDCAYSP |
| 1562 | ILB666 | QWSFHWWSHTGQAGQGSATGGSSFNEDCMWDPLLMDCAYSP |
| 1563 | ILB667 | WTFEWWIYTKGQAGQGSATGGSSFNEDCMWDPLLMDCAYSP |
| 1564 | ILB669 | ADRFFVWNPYGQAGQGSATGGSSFNEDCMWDPLLMDCAYSPQGSATGGSSFNEDCMWDPLLMDCAYSP |
| 1565 | ILB670 | QRYMMQTMLIGQAGQGSATGGSSFNEDCMWDPLLMDCAYSPQGSATGGSSFNEDCMWDPLLMDCAYSP |
| 1566 | ILB671 | PWSKATQPGWGQAGQGSATGGSGSTASSFNEDCMWDPLLMDCAYSPQGSATGGSGSTASSFNEDCMWDPLLMDCAYSPQGSATGGSGSTASSFNEDCMWDPLLMDCAYSP |
| 1567 | ILB672 | IWWGYSWDHYGQAGQGSATGGSSFNEDCMWDPLLMDCAYSP |
| 1568 | ILB673 | IVNFTWNFLSGQAGQGSFNEDCMWDPLLMDCAYSP |
| 1569 | ILB675 | MQFSWTQHFFGQAGQGSATGGSGSTASSGSGSSFNEDCMWDPLLMDCAYSPGMQFSWTQHFFGQAGQGSATGGSGSTASSGSGSSFNEDCMWDPLLMDCAYSP |
| 1570 | ILB676 | LHANSIATNWGQAGQGSATGGSSFNEDCMWDPLLMDCAYSP |
| 1571 | ILB677 | PDSWCHTLYWQLIHCERQE |
| 1572 | ILB678 | QFPYESPPSIGQAGQGSATGGSSFNEDCMWDPLLMDCAYSP |
| 1573 | ILB680 | YYQGFPWFQIGQAGQGSATGGSSFNEDCMWDPLLMDCAYSPGGGSYYQGFPWFQTGQAGQGSATGGSSFNEDCMWDPLLMDCAYSPGGGSYYQGFPWFQIGQAGQGSATGGSSFNEDCMWDPLLMDCAYSP |
| 1574 | ILB681 | YYQGFPWFQIGQAGQGSATGGSSFNEDCMWDPLLMDCAYSPGGGSYYQGFPWFQIGQAGQGSATGGSSFNEDCMWDPLLMDCAYSP |
| 1575 | ILB739 | GEAWCWDPIRMDVRVCSVFI |
| 1576 | ILB740 | GPYSCPWDPMKMECAYSP |
| 1577 | ILB741 | EYSSCNWDPLLMQCRVV |
| 1578 | ILB742 | FHSTCFWDPLLMRCVSAP |
| 1579 | ILB743 | SVSPCIWDPLLMMCGNYS |
| 1580 | ILB744 | VGVDCPWDPLMMECAGRN |
| 1581 | ILB745 | VSAECYWDPLMMQCSTDM |
| 1582 | ILB747 | FGDTCFWHPFNEDMCESKP |
| 1583 | ILB748 | QWLHCFWDPLMMKCVTVS |
| 1584 | ILB749 | TPHPCHWDPMIMYCMLEM |
| 1585 | ILB750 | HEEDCWWDPLIMQCFNRT |
| 1586 | ILB751 | HTANCPWDPLIMNCSFQS |
| 1587 | ILB752 | YTKHCQRLPTYKICNLFM |
| 1588 | ILB755 | ADSWCHTLYWQLQHCLSQE |
| 1589 | ILB756 | HSRWCYWEPIRMIEMCMGDK |
| 1590 | ILB757 | PGVACFWDPLLMSCSYDE |
| 1591 | ILB758 | RAFTCPWDPLIMDCAGAS |
| 1592 | ILB759 | GDDWCAWDPIRMQCSYTK |
| 1593 | ILB760 | EIEQCWWDPMLMEGVCWPSI |
| 1594 | ILB761 | HGRSCAWDPLKMDCVWYH |
| 1595 | ILB762 | RLGACVWDPLMMCAWIS |
| 1596 | ILB763 | LYPSCPWDPILMQCSALK |
| 1597 | ILB764 | PTPLCHWDPLLMHCTASD |
| 1598 | ILB765 | TDSWCHTLYWQLHHCAILE |
| 1599 | ILB766 | RWNVCAWDPLLMQCASAP |
| 1600 | ILB767 | MSVSCNWDPLLMTCRLPT |
| 1601 | ILB768 | PGLRCPWDPLMMTCVAHP |
| 1602 | ILB769 | QIAFCLWDPLLMDCTVQT |
| 1603 | ILB770 | SPQECPWDPIAMKCAFVR |
| 1604 | ILB771 | TSHPCWWDPIMMSCWLEE |
| 1605 | ILB772 | VQLYCIWDPLMMDCGQRS |
| 1606 | ILB773 | CRNSCHWDPLIMDCMQEM |
| 1607 | ILB774 | FNEDCMWDPLLMDCAYSPGQGSAAGGGSIVQHPSRMY |
| 1608 | ILB775 | FNEDCMWDPLLMDCAYSPAGGGSICQATPYSPWCR |

TABLE 13-continued

IL6 binding MRDs

| SEQ ID: | Ref. No. | Peptide Sequence |
|---|---|---|
| 1609 | ILB776 | HRAPCFSCTACRQPCFSLT |
| 1610 | ILB778 | FNEDCMWDPLLMDCAYSPAGGSALRMCDSWVENRCLG |
| 1611 | ILB779 | FNEDCMWDPLLMDCAYSPGQGSAAGGSAQWQCHFNPTGMACVDMLQG |
| 1612 | ILB780 | FNEDCMWDPLLMDCAYSPGQGSAAGGGSIIPWRIINMQKI |
| 1613 | ILB781 | FNEDCMWDPLLMDCAYSPGQGSAAGGGSQFPYESPPSI |
| 1614 | ILB782 | FNEDCMWDPLLMDCAYSPAGGGSVCPTQPANCQ |
| 1615 | ILB783 | FNEDCMWDPLLMDCAYSPGQGSAAGGGSPCRFWPGRAFCH |
| 1616 | ILB784 | FNEDCMWDPLLMDCAYSPGQGSATGGSAAGGGSECELDYHMVWCK |
| 1617 | ILB785 | FNEDCMWDPLLMDCAYSPGQGSAAGGGSFWMQQAQQHK |
| 1618 | ILB786 | FNEDCMWDPLLMDCAYSPGQGSAAGGGSKCDWQPWFCP |
| 1619 | ILB787 | FNEDCMWDPLLMDCAYSPAGGGSFVGESQYMQTK |
| 1620 | ILB788 | FNEDCMWDPLLMDCAYSPGQGSATGGSGSTASAAGGGSQPWRHNMQKI |
| 1621 | ILB789 | FNEDCMWDPLLMDCAYSPGQGSATGGSGSTASAAGGGSQFPYESPPSI |
| 1622 | ILB791 | FNEDCMWDPLLMDCAYSPGRGSSLGGVSPPTVSGRASA |
| 1623 | ILB792 | ANSWCHTLYWQLHHCEILE |
| 1624 | ILB793 | FNEDCMWDPLLMDCAYSPAGGGSIWQTEVIVPD |
| 1625 | ILB794 | FNEDCMWDPLLMDCAYSPGQGSATGGSGSTASAAGGGSRVRLDHWEQV |
| 1626 | ILB797 | FNEDCMWDPLLMDCAYSPGQGSATGGSAAGDGSIEHHGAWSAQ |
| 1627 | ILB798 | FNEDCMWDPLLMDCAYSPGQGSAAGGSPVLGCRNVHNTQCRLWFQG |
| 1628 | ILB799 | GLHGCQYVQMFFHFCAPKT |
| 1629 | ILB800 | FNEDCMWDPLLMDCAYSPGQGSATGGSAAGGSHWERCVPHSDPDYNCSFDS |
| 1630 | ILB801 | FNEDCMWDPLLMDCAYSPAGGSGWVFRCKNMPCAKAEH |
| 1631 | ILB802 | FNEDCMWDPLLMDCAYSPGQGSAAGGGSPPHPSNSIWR |
| 1632 | ILB803 | FNEDCMWDPLLMDCAYSPGQGSATGGSAAGGSRLSLHCPEHPCGSSWTQG |
| 1633 | ILB804 | FNEDCMWDPLLMDCAYSPAGGGSPDWITWQPAW |
| 1634 | ILB806 | FQGHCALFPTDWICTLKS |
| 1635 | ILB807 | FNEDCMWDPLLMDCAYSPGQGSAAGGSVGLLCQDFAYGQTHCDVLQQG |
| 1636 | ILB808 | FNEDCMWDPLLMDCAYSPGQGSAAGDGSMCYQEPHFTYCP |
| 1637 | ILB809 | FNEDCMWDPLLMDCAYSPGQGSAAGGGSECMSSWHGCT |
| 1638 | ILB810 | FNEDCMWDPLLMDCAYSPGQGSATGGSGSTASAAGGSDAWGCLDDFFMKVAGCKTLF |
| 1639 | ILB811 | FNEDCMWDPLLMDCAYSPGQGSAAGGSQFLLCNGSEWCPANRQG |
| 1640 | ILB812 | FNEDCMWDPLLMDCAYSPGQGSAAGGGSFCMWPFCIPPR |
| 1641 | ILB813 | FNEDCMWDPLLMDCAYSPGQGSAAGGGSMGGEDDIWHQ |
| 1642 | ILB814 | PDSRCHTLYWALRYCAYQE |
| 1643 | ILB815 | FNEDCMWDPLLMDCAYSPGQGSATGGSAAGGGSWHSYTAMYAD |
| 1644 | ILB816 | FNEDCMWDPLLMDCAYSPGQGSAAGGGSGMVSHWKKVQ |
| 1645 | ILB817 | FNEDCMWDPLLMDCAYSPGQGSATGGSGSTASAAGGSQGMPCQYHAMQLCPPSR |
| 1646 | ILB818 | FNEDCMWDPLLMDCAYSPGQGSATGGSGSTASAAGGGSHQHNFQLRYT |
| 1647 | ILB819 | FNEDCMWDPLLMDCAYSPGQGSAAGGGSLCDQWQSARYCV |
| 1648 | ILB820 | FNEDCMWDPLLMDCAYSP |
| 1649 | ILB821 | FNEDCMWDPLLMDCAYSPGQGSAAGGGSYCHEDPRSLDCR |
| 1650 | ILB822 | FNEDCMWDPLLMDCAYSPGQGSAAGGGSHPWRHNMHKI |
| 1651 | ILB823 | FNEDCMWDPLLMDCAYSPGQGSAAGGSPLVDCLTYPEWVNCPRTIQG |
| 1652 | ILB824 | FNEDCMWDPLLMDCAYSPGQGSAAGGGSDCNFAPKETNCW |
| 1653 | ILB825 | FNEDCMWDPLLMDCAYSPGQGSATGGSGSTASAAGGSKTLFCGYDGYDMCDLSA |
| 1654 | ILB826 | FNEDCMWDPLLMDCAYSPGQGSAAGGGSWNRHPPPSGQ |

TABLE 13-continued

IL6 binding MRDs

| SEQ ID: | Ref. No. | Peptide Sequence |
|---|---|---|
| 1655 | ILB827 | FNEDCMWDPLLMDCAYSPAGGGSMQYHPWQDMW |
| 1656 | ILB828 | FNEDCMWDPLLMDCAYSPGQGSAAGGGSSCNITDQMGVCL |
| 1657 | ILB829 | FNEDCMWDPLLMDCAYSPGQGSATGGSAAGGSWDDTCNAEVYQQGLMCDTRVQG |
| 1658 | ILB831 | FNEDCMWDPLLMDCAYSPGQGSAAGGSARRGCVMLNECSSVSQG |
| 1659 | ILB832 | FNEDCMWDPLLMDCAYSPGQGSAAGGSRMRSVCPHHVCWRGVPQG |
| 1660 | ILB833 | FNEDCMWDPLLMDCAYSPAGGSPKSECVAPLEMIECPSLW |
| 1661 | ILB834 | FNEDCMWDPLLMDCAYSPGQGSAAGGSSVFWCYSQHGCALTSQG |
| 1662 | ILB835 | FNEDCMWDPLLMDCAYSPGQGSAAGGGSPRAWQFPVSS |
| 1663 | ILB836 | FNEDCMWDPLLMDCAYSPGQGSATGGSAAGGGSICMEYPIIRPCT |
| 1664 | ILB837 | FNEDCMWDPLLMDCAYSPGQGSAAGGGSPCLSWYVAPMF |
| 1665 | ILB838 | FNEDCMWDPLLMDCAYSPGQGSAAGGSADDCCVSHLPFIGYCGFVRQG |
| 1666 | ILB840 | FNEDCMWDPLLMDCAYSPGQGSATGGSGSTASAAGGSGEDQCKLFGSGLDTCIPYV |
| 1667 | ILB842 | FNEDCMWDPLLMDCAYSPGQGSAAGGGSPCVKAPEFDWCT |
| 1668 | ILB843 | FNEDCMWDPLLMDCAYSPGQGSAAGGSHESCAVHYQGCPYASQG |
| 1669 | ILB844 | FNEDCMWDPLLMDCAYSPGQGSATGGSGSTASAAGNCSCFIKPVGPDCWAVS |
| 1670 | ILB845 | QAASAPASEPPGSLCLPDQFRCGNGQCIPLDWVCDGVNDCPDDSDEEGCPPRTCAPSQFQCGSGYCISQRWVCDGENDCEDGSDEANCAGSVPTCPSDEFR |
| 1671 | ILB846 | FNEDCMWDPLLMDCAYSPGQGSAAGGGSEEQPTEWHVY |
| 1672 | ILB847 | FNEDCMWDPLLMDCAYSPAGGSETFDCNTPWEHECYGRF |
| 1673 | ILB848 | FNEDCMWDPLLMDCAYSPGQGSATGGSAAGGSETLPCQYWGQSWCSQSAQG |
| 1674 | ILB849 | FNEDCMWDPLLMDCAYSPGQGSATGGSGSTASAAGGGSPCTPWTEWQQCP |
| 1675 | ILB850 | FNEDCMWDPLLMDCAYSPGQGSAAGGSHSMLCQPWHLCPPAQQG |
| 1676 | ILB851 | FNEDCMWDPLLMDCAYSPGQGSATGGSGSTASAAGGGSKCSIDVQQCM |
| 1677 | ILB852 | FNEDCMWDPLLMDCAYSPGQGSAAGGGSQPWRHNMQKI |
| 1678 | ILB853 | FNEDCMWDPLLMDCAYSPGQGSATGGSAAGGGSHHKNNGTIYQ |
| 1679 | ILB854 | FNEDCMWDPLLMDCAYSPGQGSAAGGGSPAERMKMHMF |
| 1680 | ILB855 | FNEDCMWDPLLMDCAYSPGQGSAAGGGSREFTQNWSIY |
| 1681 | ILB856 | FNEDCMWDPLLMDCAYSPGQGSATGGSGSTASAAGGGSAYTMWQYHKF |
| 1682 | ILB857 | FNEDCMWDPLLMDCAYSPGQGSAAGGGSYMGQIPAHNI |
| 1683 | ILB858 | FNEDCMWDPLLMDCAYSPGQGSATGGSAAGGGSKCWSFSGNRPCP |
| 1684 | ILB860 | FNEDCMWDPLLMDCAYSPGQGSAAGGGSPDWITWQPAW |
| 1685 | ILB861 | FNEDCMWDPLLMDCAYSPGQGSATGGSAAGGSYQPGCAQWWDMERGCFITQ |
| 1686 | ILB862 | FNEDCMWDPLLMDCAYSPGQGSAAGGGSSYWEHGWPWQ |
| 1687 | ILB863 | FNEDCMWDPLLMDCAYSPGQGSAAGGGSWPSPPWKQMV |
| 1688 | ILB864 | FNEDCMWDPLLMDCAYSPAGGGSDEFQFGSEMM |
| 1689 | ILB865 | FNEDCMWDPLLMDCAYSPGQGSAAGGGSINALGVAVQH |
| 1690 | ILB866 | FNEDCMWDPLLMDCAYSPGQGSAAGGGSQWQWKIHPAE |
| 1691 | ILB867 | FNEDCMWDPLLMDCAYSPGQGSAAGGGSLCERPLHTPWA |
| 1692 | ILB868 | FNEDCMWDPLLMDCAYSPGQGSAAGGGSPWAKNRHEAV |
| 1693 | ILB869 | FNEDCMWDPLLMDCAYSPAGGGSQPWRHNMQKI |
| 1694 | ILB870 | FNEDCMWDPLLMDCAYSPAGGSIRGLSCWPQDCGLEEL |
| 1695 | ILB871 | FNEDCMWDPLLMDCAYSPGQGSAAGGGSLNFGSYSTPH |
| 1696 | ILB872 | FNEDCMWDPLLMDCAYSPGQGSAAGGGSHYLWQEKTYK |
| 1697 | ILB873 | FNEDCMWDPLLMDCAYSPGQGSATGGSGSTASAAGGGSDCGANHEHCS |

TABLE 13-continued

IL6 binding MRDs

| SEQ ID: | Ref. No. | Peptide Sequence |
|---|---|---|
| 1698 | ILB874 | FNEDCMWDPLLMDCAYSPGQGSATGGSGSTASAAGGGSRVQIIVPEKW |
| 1699 | ILB875 | FNEDCMWDPLLMDCAYSPGQGSAAGGGSEHHWEHPTNF |
| 1700 | ILB876 | FNEDCMWDPLLMDCAYSPGQGSATGGSAAGGSSAIIDCTEESWCWMEVQG |
| 1701 | ILB877 | FNEDCMWDPLLMDCAYSPGQGSATGGSAAGGSYSFRCDVEPHQPGCFDLIQG |
| 1702 | ILB878 | FNEDCMWDPLLMDCAYSPGQGSAAGGGSLMYMWEPRTQ |
| 1703 | ILB879 | FNEDCMWDPLLMDCAYSPGQGSAAGGSLEASCAQSDQCFRQSQG |
| 1704 | ILB880 | FNEDCMWDPLLMDCAYSPGQGSATGGSGSTASAAGGGSLCFSNWDEMKCF |
| 1705 | ILB881 | FNEDCMWDPLLMDCAYSPGQGSATGGSAAGGGSICNWEEVDPHCA |
| 1706 | ILB882 | FNEDCMWDPLLMDCAYSPGQGSAAGGGSPWLDPQWDIW |
| 1707 | ILB883 | FNEDCMWDPLLMDCAYSPAGGSRNSWICMEWHCSDLTR |
| 1708 | ILB884 | FNEDCMWDPLLMDCAYSPGQGSATGGSAAGGGSWGYQQSWVQQ |
| 1709 | ILB885 | FNEDCMWDPLLMDCAYSPGQGSATGGSAAGGSLTVSNCQEEICMQDEYQG |
| 1710 | ILB886 | FNEDCMWDPLLMDCAYSPGQGSAAGGGSQCKAYMPQCA |
| 1711 | ILB887 | FNEDCMWDPLLMDCAYSPAGGGSSWQRHDGHQI |
| 1712 | ILB888 | FNEDCMWDPLLMDCAYSPGQGSATGGSAAGGGSTREMLVHPRH |
| 1713 | ILB889 | FNEDCMWDPLLMDCAYSPGQGSATGGSGSTASAAGGGSQQKERISPWP |
| 1714 | ILB890 | FNEDCMWDPLLMDCAYSPGQGSAAGGGSFNINNIYVGN |
| 1715 | ILB891 | FNEDCMWDPLLMDCAYSPGQGSAAGGGSVSSYNPWIIY |
| 1716 | ILB892 | FNEDCMWDPLLMDCAYSPGQGSAAGGSMQTSCEFHEKYERHGCQQLSQG |
| 1717 | ILB893 | FNEDCMWDPLLMDCAYSPGQGSAAGGGSNCLIAEWECE |
| 1718 | ILB894 | FNEDCMWDPLLMDCAYSPGQGSAAGGGSWEVPRSLWGQGQAGPGGGSG |
| 1719 | ILB895 | FNEDCMWDPLLMDCAYSPGQGSATGGSGSTASAAGGGSMSLECESYGIGWCSLLII |
| 1720 | ILB896 | FNEDCMWDPLLMDCAYSPGQGSAAGGSHISTCKLIMGAYAHCQTPSQG |
| 1721 | ILB897 | FNEDCMWDPLLMDCAYSPGQGSAAGGGSLQQGRRHHMR |
| 1722 | ILB898 | FNEDCMWDPLLMDCAYSPGQGSAAGGSNIDFQCYPFKCGVLFSQG |
| 1723 | ILB899 | FNEDCMWDPLLMDCAYSPGQGSAAGGGSGCSSTPFAWSCS |
| 1724 | ILB900 | FNEDCMWDPLLMDCAYSPGQGSATGGSGSTASAAGGGSPCQNQPSYQVCT |
| 1725 | ILB901 | FNEDCMWDPLLMDCAYSPGQGSATGGSAAGGSLRQSCYPIPESEKCSFSNQG |
| 1726 | ILB902 | FNEDCMWDPLLMDCAYSPGQGSAAGGGSFFHWPTKAKE |
| 1727 | ILB903 | FNEDCMWDPLLMDCAYSPGQGSATGGSAAGGGSQCEFEQEECW |
| 1728 | ILB904 | FNEDCMWDPLLMDCAYSPGQGSATGGSAAGGSGVTGCSGFPTTGTCSQHEQG |
| 1729 | ILB905 | FNEDCMWDPLLMDCAYSPGQGSATGGSAAGGGSLDYHDIPRHA |
| 1730 | ILB906 | FNEDCMWDPLLMDCAYSPGQGSATGGSAAGGGSSGWEHSSIVF |
| 1731 | ILB907 | FNEDCMWDPLLMDCAYSPGQGSAAGGGSWWSPAYGWQN |
| 1732 | ILB908 | FNEDCMWDPLLMDCAYSPGQGSAAGGGSQCALKSFTVPCN |

TABLE 14

IL6R binding MRDs

| SEQ ID: | Ref. No. | Peptide Sequence |
|---|---|---|
| 1747 | ILC19 | GDWEWVWDWCF |
| 1748 | ILC20 | PCQWVIYHCF |
| 1749 | ILC21 | WEIEWSWYWD |
| 1750 | ILC23 | FYMEFIIWSP |
| 1751 | ILC24 | WYWMLEWEWD |
| 1752 | ILC25 | PCEEAFAAYLE |
| 1753 | ILC27 | QCFAWEFVWHCD |
| 1754 | ILC28 | YTWDLYIYQA |

TABLE 14-continued

IL6R binding MRDs

| SEQ ID: | Ref. No. | Peptide Sequence |
|---|---|---|
| 1755 | ILC31 | MYTEWQMWWIGQAGQGGGSGGGGSFYDQWEVELH |
| 1756 | ILC33 | AEFDWMQYGYGQAGQGGGSGGGGSYEFNWKYQEW |
| 1757 | ILC34 | YMQWKVEWWG |
| 1758 | ILC35 | WEITWDWEYY |
| 1759 | ILC39 | WCLITPWEVQCY |
| 1760 | ILC40 | TTMVFQASLG |
| 1761 | ILC41 | LCFCYEYEWVH |
| 1762 | ILC42 | HWEFYYEFGI |
| 1763 | ILC43 | LCYWEVWFTWE |
| 1764 | ILC44 | PCYLVMMEWECM |
| 1765 | ILC46 | GCDFYMNLCK |
| 1766 | ILC50 | WQEQWWYKQH |
| 1767 | ILC52 | SELSCYWEMKWECSWVT |
| 1768 | ILC53 | FCWSCEVFQMEICDELG |
| 1769 | ILC55 | HALHCANEERIFVQCLESS |
| 1770 | ILC56 | VYLECNVYEWPEAWCVVMP |
| 1771 | ILC57 | TQHLCAWDVRSQADMCIYWT |
| 1772 | ILC58 | QVYVCYVLAEQHEAICTSWA |
| 1773 | ILC59 | LTWVCTVMQHMNHMECLLDL |
| 1774 | ILC60 | MLLHCPAMWKCQSDL |
| 1775 | ILC61 | LTWDCYQVFEEWYDCTMSII |
| 1776 | ILC62 | VWGGCWYHFTIQHWCPTLS |
| 1777 | ILC63 | MTILCYEQREDMWDCWNVF |
| 1778 | ILC64 | LDCACHFEEHVRTIFCSIGH |
| 1779 | ILC65 | WLVDCWVVEDMNMICRLYE |
| 1780 | ILC66 | LDFLCYENIHNNFDCFRVM |
| 1781 | ILC67 | VASHCIQMPHWLLCQTLI |
| 1782 | ILC70 | WTVWCEWENEYGGWCDVSL |
| 1783 | ILC71 | LQCKCDEPYPSYYTCRVYF |
| 1784 | ILC74 | GPFMCMMDLHRDELLHCWASD |
| 1785 | ILC75 | VAVDCFWVTPYEPWYCTVMS |
| 1786 | ILC77 | MTDRCYTYEWQYTVCYGRN |
| 1787 | ILC80 | RDWRCYLMAHWVHVCGPFIGQAGQGGPGWAGGSDMDLCQDWVYESKYCVPLA |
| 1788 | ILC83 | SRYVICDLDMVFRECHGAF |
| 1789 | ILC84 | SALVLCELEMVFRECHGVL |
| 1790 | ILC86 | SEFILCDLAMVFAECHGAA |
| 1791 | ILC89 | SELLLCAFDMVISECHGTT |
| 1792 | ILC90 | DSFGCTWEVWGRECHPQL |
| 1793 | ILC93 | SEFIFCDLEMVFRECIIGTT |
| 1794 | ILC95 | SEFVYCMLDMVFRECHGTA |
| 1795 | ILC96 | SELILCALEMVFNECHGAV |
| 1796 | ILC97 | SDLVLCEWDMVVRECHGVF |
| 1797 | ILC99 | SDLIWCELDMVFRECHGAA |
| 1798 | ILC102 | SSFVFCDLEMVFRECHGVF |
| 1799 | ILC103 | SDLILCNLEMVFKECHGVI |
| 1800 | ILC106 | SSLILCDLEMVFKECHGVL |
| 1801 | ILC108 | SEIVLCEWAMVLAECHGAA |
| 1802 | ILC144 | SRCDRVLGTHINL |
| 1803 | ILC164 | SHEEWTCFPYLCTFWAE |
| 1804 | ILC165 | SEEEWTCFPYLCSIWLE |
| 1805 | ILC166 | SQEEWTCFPYLCSYWLE |
| 1806 | ILC167 | SQEEWTCFPYLCSFWSE |
| 1807 | ILC169 | SHEEWTCFPYLCKYWLH |
| 1808 | ILC170 | SHEDWTCFPYLCKVLLH |
| 1809 | ILC171 | SHEEWTCFPYLCENWLH |
| 1810 | ILC172 | SEEEWTCFPYLCTDWVH |
| 1811 | ILC173 | SEEEWTCFPYLCTILLQ |
| 1812 | ILC174 | SDEEWTCFPYLCSVWVE |
| 1813 | ILC175 | SEEEWTCFPYLCSYLLH |
| 1814 | ILC176 | SHEDWTCFPYLCKYLLD |
| 1815 | ILC177 | SQEEWTCFPYLCREWVE |
| 1816 | ILC178 | SDEEWTCFPYLCSQWVE |
| 1817 | ILC179 | SEEEWTCFPYLCREWAH |
| 1818 | ILC180 | SEEEWTCFPYLCSYWLD |
| 1819 | ILC181 | SEEEWTCFPYLCSQWLE |
| 1820 | ILC182 | SEEEWTCFPYLCTNWLH |
| 1821 | ILC183 | SHEDWTCPPYLCRILVE |
| 1822 | ILC184 | SDEEWTCFPSLCTQLLQ |
| 1823 | ILC185 | SEEDWTCFPYLCRILVE |
| 1824 | ILC186 | SHEEWTCFPYLCGKWAE |
| 1825 | ILC187 | SIIEDWTCFPYLCSILLQ |
| 1826 | ILC189 | SHEDWTCPPYLCRVLLE |
| 1827 | ILC190 | SDEEWTCFPYLCTFWLQ |

TABLE 14-continued

IL6R binding MRDs

| SEQ ID: | Ref. No. | Peptide Sequence |
|---|---|---|
| 1828 | ILC191 | SEEEWTCFPYLCRNWLD |
| 1829 | ILC192 | SEEEWTCFPYLCGLWVE |
| 1830 | ILC193 | SEEDWTCFPYLCRILLD |
| 1831 | ILC194 | SHEDWTCFPYLCRILSH |
| 1832 | ILC195 | SEEEWTCFPYLCTNWLD |
| 1833 | ILC196 | SEEEWTCFPYLCSDWLE |
| 1834 | ILC197 | SEEEWTCFPYLCTHWLH |
| 1835 | ILC198 | SEEEWTCFPSLCNFWSQ |
| 1836 | ILC199 | SQEEWTCFPYLCTYWLQ |
| 1837 | ILC200 | SHEEWTCFPYLCTYWSH |
| 1838 | ILC201 | SDEEWTCFPYLCSIWAQ |
| 1839 | ILC202 | SDEEWTCFPYLCSYWVD |
| 1840 | ILC203 | SHEEWTCFPYLCRILLD |
| 1841 | ILC204 | SQEEWTCFPYLCTDWLH |
| 1842 | ILC205 | SEEEWTCFPYLCSFWLE |
| 1843 | ILC206 | SHEDWTCFPYLCTLLLQ |
| 1844 | ILC207 | SHEDWTCFPYLCNILLQ |
| 1845 | ILC208 | SEEEWTCFPYLCSHWAE |
| 1846 | ILC209 | SHEEWTCFPYLCKILLE |
| 1847 | ILC210 | SQEEWTCFPYLCSYWLQ |
| 1848 | ILC211 | SEEEWTCFPYLCSIWLD |
| 1849 | ILC212 | SHEEWTCFPTLCTDWLQ |
| 1850 | ILC213 | SEEEWTCFPSLCTIWLQ |
| 1851 | ILC214 | SHEEWTCFPYLCSDWLQ |
| 1852 | ILC215 | SEEEWTCFPYLCSLWVD |
| 1853 | ILC216 | SHEEWTCFPYLCSVWAQ |
| 1854 | ILC218 | SHEEWTCFPYLCSLWAQ |
| 1855 | ILC219 | SDEEWTCFPTLCTDWLQ |
| 1856 | ILC220 | SQEEWTCFPYLCSHWLD |
| 1857 | ILC221 | SEAEWTCFPYLCSDWLH |
| 1858 | ILC222 | SEEEWTCFPYLCGQWVE |
| 1859 | ILC223 | SDEEWTCFPSLCSFWLE |
| 1860 | ILC224 | SEEEWTCFPYLCTLWSQ |
| 1861 | ILC225 | SDEEWTCFPTLCSLWSE |
| 1862 | ILC226 | SDEEWTCFPSLCSFWLD |
| 1863 | ILC227 | SQEEWTCFPYLCTDWVQ |
| 1864 | ILC228 | SEEEWTCFPYLCSILVD |
| 1865 | ILC229 | SEEEWTCFPYLCSKLLH |

TABLE 14-continued

IL6R binding MRDs

| SEQ ID: | Ref. No. | Peptide Sequence |
|---|---|---|
| 1902 | ILC282 | SHEEWTCFPYLCSYWLE |
| 1903 | ILC283 | FMV HCTWYDVTID CVGPT |
| 1904 | ILC284 | SDI SCSYIDGWYQ CLLHL |
| 1905 | ILC285 | WGC LCQQQGHFME CEITW |
| 1906 | ILC286 | ESL LCIQHDVWVD CYIVE |
| 1907 | ILC287 | NSS FCYIHAIEWV CESSS |
| 1908 | ILC288 | DLL YCEWEMVVRE CHGTIGQ |
| 1909 | ILC292 | QIVECWTEMDWHHCVLFF |

TABLE 15

IL17a binding MRDs

| SEQ ID: | Ref. No. | Peptide Sequence |
|---|---|---|
| 1932 | ILA1 | LSLWCWHDQAEFCVESN |
| 1933 | ILA2 | SKYDCFWEHEWLYCAPRM |
| 1934 | ILA3 | FDLYCWVWPDMMECTAGT |
| 1935 | ILA4 | GTWDCWVEGEWVYCTPWS |
| 1936 | ILA5 | STEGCHQDWYDLCAFLA |
| 1937 | ILA6 | LSLWCWMFPEHNACLSPV |
| 1938 | ILA7 | ESLWCWMFPNEQ

TABLE 16

TL1A binding MRDs

| SEQ ID: | Ref. No. | Peptide Sequence |
|---|---|---|
| 1993 | TLA26 | LLGDCFAGFDNIWCEFLD |
| 1994 | TLA29 | KCNFNPWKAACG |
| 1995 | TLA30 | QTFWCYDDWHECSGKP |
| 1996 | TLA34 | LNHSCWWWDEWEECPHNV |
| 1997 | TLA37 | KVEYCYDDWHQCKQVQ |
| 1998 | TLA38 | DDSMCAWWDEWHECEHHS |
| 1999 | TLA39 | EYMYCYDDWYDC |
| 2000 | TLA43 | DNTDCYYQGYWVYCTDLN |
| 2001 | TLA44 | RSDVCWDMAAQHLFYCGEWI |
| 2002 | TLA46 | RYDVCWDQKLQELYYCSYYH |
| 2003 | TLA47 | LSSVCWNNSAEKLEYCGPLE |
| 2004 | TLA49 | HITICDYQEYFYMCTILY |
| 2005 | TLA50 | DMAGCHWDPVYINFDCRASM |
| 2006 | TLA56 | KFNECFVGYDYIWCNSSV |
| 2007 | TLA58 | GEDTCHWVHFIDDWYCLAPM |
| 2008 | TLA62 | EVTICQYTEDFTYYYCTRPN |
| 2009 | TLA70 | EVCWDSESESIQWCDMEW |
| 2010 | TLA72 | PFVVCYTQWQGEREFHNCWKLQ |
| 2011 | TLA77 | QTVRVCFYDRCQDVKF |
| 2012 | TLA81 | QKAICWNTEHITYYYCSRPN |
| 2013 | TLA85 | SSWDCMGGPIVWVCPEGR |
| 2014 | TLA88 | RVEECSYEFRQCLANY |
| 2015 | TLA89 | DYDVCWDVLADRLYYCDEPI |
| 2016 | TLA90 | DSFGCTWEVWGRECHPQL |
| 2017 | TLA91 | DYDVCWDLEVDRLYYCDDPL |
| 2018 | TLA92 | DYDVCWDVQLDRLYYCDVPM |
| 2019 | TLA93 | DYDVCWDIHADRLYYCNAPF |
| 2020 | TLA94 | DIDVCWDIAADRLYYCHAPM |
| 2021 | TLA95 | DIIDVCWDIDIDRLYYCEGPW |
| 2022 | TLA97 | MYDVCWDLQVDKLYFCGDDL |
| 2023 | TLA98 | DWDVCWDVEVDRLFYCEAPT |
| 2024 | TLA99 | DFDVCWDLDLRLVYCDAPM |
| 2025 | TLA101 | DYDVCWDVHLDRLYYCNSPI |
| 2026 | TLA102 | DYDVCWDIDEDRLYYCDAFL |
| 2027 | TLA103 | DYDVCWDLLVDRLYYCDGPT |
| 2028 | TLA104 | DYDVCWDIYDDRLYYCDTPV |
| 2029 | TLA105 | ALDVCWDIEEDRLYYCDAPL |
| 2030 | TLA106 | DYDVCWDVYHDRLFYCEDHL |
| 2031 | TLA107 | DYDVCWDFEVDRLYYCDGPG |
| 2032 | TLA108 | EYDVCWDIDVDRLYYCASPM |
| 2033 | TLA109 | DYDVCWDIELDRLYYCDASI |
| 2034 | TLA110 | DYDVCWDVELDRLYYCEAPL |
| 2035 | TLA111 | YYDVCWDLDLDILYYCDAPG |
| 2036 | TLA113 | DYEVCWDLQMDRLYYCEASI |
| 2037 | TLA114 | IFDVCWDVDEDRLYYCQAET |
| 2038 | TLA115 | YTDVCWDIDVDRLYYCDADV |
| 2039 | TLA117 | EDAVCWDPAHEKLVWCNRFE |
| 2040 | TLA118 | DYDVCWDVNADRLFYCDDAI |
| 2041 | TLA119 | DYDVCWDVDEDRLYYCNVPI |
| 2042 | TLA120 | DYDVCWDLDFDRLYYCHPAE |
| 2043 | TLA121 | RWDVCWDYHADKLFFCNEDL |
| 2044 | TLA122 | DYDVCWDVDLDRLYYCEAPM |
| 2045 | TLA123 | EYEVCWDVHVHRLVFCNVPV |
| 2046 | TLA125 | KTDVCWDLLLDKLYFCDIDT |
| 2047 | TLA126 | RDDVCWDYNTDKLYFCGSNI |
| 2048 | TLA127 | DYDVCWDYDVDRLYYCDFPV |
| 2049 | TLA128 | NYDVCWDVSEDRLYYCDAPR |
| 2050 | TLA129 | DWDVCWDLLEDRLYYCEDPM |
| 2051 | TLA130 | EYDHCWDSRAKLELCWEHN |
| 2052 | TLA131 | EYAVCWDEAQQKLVWCKDLN |
| 2053 | TLA133 | DYDVCWDIYEDRLFYCEMHV |
| 2054 | TLA134 | KLDVCWDLDVDRLYFCDAPM |
| 2055 | TLA135 | DYDVCWDVLVDRLYYCDVPM |
| 2056 | TLA136 | DYDVCWDLHLDRLYYCHAYC |
| 2057 | TLA138 | DYDVCWDIDLDRLYYCDAGS |
| 2058 | TLA139 | DYDVCWDIDADRLYYCHAAM |
| 2059 | TLA140 | KYDVCWDDYLDILYYCNGPL |
| 2060 | TLA141 | HLDVCWDIDLDHLYYCDLGM |
| 2061 | TLA142 | MYDVCWDLEVDRLYYCEAPM |
| 2062 | TLA143 | EYDVCWDIDSDRLYLCVGLM |
| 2063 | TLA144 | DYDVCWDVHADRLYYCKEDI |
| 2064 | TLA145 | DYDVCWDLNLDRLYYCDSPM |
| 2065 | TLA146 | EYDVCWDVQNDRLYYCDAPE |
| 2066 | TLA147 | DYDVCWDYDVDRLYYCNFQS |
| 2067 | TLA148 | DYDVCWDYKIDHLYYCDGPV |

TABLE 16-continued

TL1A binding MRDs

| SEQ ID: | Ref. No. | Peptide Sequence |
|---|---|---|
| 2068 | TLA149 | GYDVCWDYEEDRLFYCESPL |
| 2069 | TLA150 | DYDVCWDLDNDRLFYCDSAM |
| 2070 | TLA290 | KFHVCWDSHQDKLVYCSLKV |
| 2071 | TLA291 | LEFVCWDDDRGKLVFCAGHM |
| 2072 | TLA293 | GHEVCWDMHNEKLVFCRTHI |
| 2073 | TLA294 | NKAVCWNYIIQEKLEFCNSTM |
| 2074 | TLA295 | TYAVCWDFNAHKLVFCDDMM |
| 2075 | TLA296 | EYALCWVEAQEKLVWCKDLI |
| 2076 | TLA297 | DYAVCWVEDQGKLVWCNGVN |
| 2077 | TLA298 | DYAVCWDEAQEKLVWCNGLS |
| 2078 | TLA299 | EYAVCWVHSQEKLDWCTGSK |
| 2079 | TLA300 | EYAVCWNEARGKLEYCTALK |
| 2080 | TLA301 | DYAVCWDEHKQKLEFCRTFI |
| 2081 | TLA302 | EYTVCWDASNEKLYFCHYPL |
| 2082 | TLA303 | SLDVCWDHHLDKLTFCNLNM |
| 2083 | TLA304 | QLDVCWDDHYQKLYFCYARI |
| 2084 | TLA306 | SYDVCWDSRLTKLVYCNASN |
| 2085 | TLA307 | QYAVCWDEALEKLLWCKELH |
| 2086 | TLA308 | DYAVCWSEAQDKLEWCTGHN |
| 2087 | TLA309 | EYAVCWVEEIIEKLLWCEGLN |
| 2088 | TLA310 | EYSVCWVVDQEKLVWCRSLH |
| 2089 | TLA311 | EYAVCWSEAQGKLEWCQGSN |
| 2090 | TLA312 | DYAVCWDVGLEKLVWCKGSL |
| 2091 | TLA313 | PPAVCWDNNSSKLVFCHSFI |
| 2092 | TLA314 | SSNVCWDDVLETLRFCHTHM |
| 2093 | TLA315 | LDQVCWDLYANKLIFCADVI |
| 2094 | TLA316 | NLDVCWDNNRGKLMFCRNHD |
| 2095 | TLA317 | SYAVCWNALEEKLVFCTDEI |
| 2096 | TLA318 | PNEVCWDSHKEKLVFCTHQM |
| 2097 | TLA319 | EYALCWLEAQEKLDWCTELN |
| 2098 | TLA321 | ENAVCWDESQEKLVWCNGIR |
| 2099 | TLA323 | ESDVCWNENVEQLEFCNGRF |
| 2100 | TLA324 | EYAVCWDEAPEKLIWCEGLN |
| 2101 | TLA325 | RWAVCWDTDRQKLLFCGPML |
| 2102 | TLA326 | LDLVCWDENSQKLLFCTKPG |
| 2103 | TLA327 | QSSVCWDYNSQKLRFCDMSL |
| 2104 | TLA328 | RLDVCWDEHASKLVFCRSYM |
| 2105 | TLA329 | ISAVCWDTQLQKLVFCNASM |

TABLE 16-continued

TL1A binding MRDs

| SEQ ID: | Ref. No. | Peptide Sequence |
|---|---|---|
| 2106 | TLA330 | LDTVCWDIHSGRLVFCASLL |
| 2107 | TLA331 | EYALCWDDPLEKLQWCKDIS |
| 2108 | TLA332 | EYALCWNEVQEKLVWCKELN |
| 2109 | TLA333 | EYAVCWDEVQDKLVWCNGVN |
| 2110 | TLA334 | EYAVCWDEVQERLEWCTRPN |
| 2111 | TLA335 | EFAVCWDDGQEKLVWCNRLH |
| 2112 | TLA336 | EYALCWNEVHEQLEFCIGRN |
| 2113 | TLA337 | RSEVCWDTHLFKLVYCQDWF |
| 2114 | TLA338 | QSYVCWDEHQSRLRFCSETI |
| 2115 | TLA339 | PDTVCWDDHLGKLMFCSSIM |
| 2116 | TLA340 | RNHVCWDEYTEKLRFCGDGA |
| 2117 | TLA341 | HSDVCWDDHMDKLAFCWHMI |
| 2118 | TLA342 | FTAVCWDYHSNKLQFCSTLM |
| 2119 | TLA343 | DYAVCWDDVRGKLVWCKGLK |
| 2120 | TLA344 | EYDLCWDEIRQKLEWCQGLT |
| 2121 | TLA345 | EYAVCWDAENEKLEWCEGLN |
| 2122 | TLA346 | KHFVCWDELNEKLVWCKGLI |
| 2123 | TLA347 | EYAVCWNEDHAKLEWCQELN |
| 2124 | TLA349 | LSMVCWDQHQERLVFCINRM |
| 2125 | TLA350 | AQYVCWDDKEQKLKFCEDQM |
| 2126 | TLA351 | RYAVCWDESTEKLVYCQNQM |
| 2127 | TLA352 | NEFVCWDEYKNKLVFCVPTL |
| 2128 | TLA353 | RFFVCWDHDNSKLVFCSQNM |
| 2129 | TLA356 | RYAVCWDEAQEKLVWCGRVN |
| 2130 | TLA357 | AFDVCWVEALEKLEWCLGHN |
| 2131 | TLA358 | SSDVCWEAHSEKLYFCDPAR |
| 2132 | TLA359 | KLYVCWDKYKEKLVFCQALM |
| 2133 | TLA360 | KSEVCWDYDMNKLMFCFYDM |
| 2134 | TLA361 | LDAVCWDTQQQKLRFCHTHM |
| 2135 | TLA362 | RSDVCWDAHLDKLIFCAGVM |
| 2136 | TLA364 | DHAVCWNEFQEKLDWCTGLN |
| 2137 | TLA366 | QNDVCWDYHRGKLAFCEALI |
| 2138 | TLA367 | DTDVCWDHVQGKLYFCTKSL |
| 2139 | TLA368 | TSDVCWNYHYSKLQFCQQSM |
| 2140 | TLA369 | LQDVCWDLYYQKLYFCHQPM |
| 2141 | TLA370 | STDVCWDRDHDKLMFCMSVR |
| 2142 | TLA371 | DYAVCWDEAQGKLGWCIGMN |

TABLE 16-continued

TL1A binding MRDs

| SEQ ID: | Ref. No. | Peptide Sequence |
|---|---|---|
| 2143 | TLA372 | EYAVCWDDAQERLEWCKEPL |
| 2144 | TLA373 | EYAVCWDESLEKLEWCTGLY |
| 2145 | TLA374 | EYAVCWDEAQQRLIWCKGLY |
| 2146 | TLA375 | EYALCWDQDKEILHWCVEFY |
| 2147 | TLA376 | DNEVCWDGHVDRLVFCDSTM |
| 2148 | TLA377 | NHDVCWDFHVDRLVYCDTPI |
| 2149 | TLA378 | DYAVCWDAHMDHLVYCDAIA |
| 2150 | TLA379 | DYEVCWDDYADRLVYCDLSL |
| 2151 | TLA380 | SYEVCWDVHLDRLVYCNSVM |
| 2152 | TLA381 | HYAVCWDFHLDRLVYCDRPS |
| 2153 | TLA382 | DYEVCWDVIRGRLVYCETPM |
| 2154 | TLA383 | AYEVCWDVNLDRLVYCEALM |
| 2155 | TLA384 | GYEVCWDLKWDRLVFCDAPI |
| 2156 | TLA385 | ALEVCWDFDVDHLVYCAAAL |
| 2157 | TLA386 | EFEVCWDVHLDRLVYCHATM |
| 2158 | TLA388 | QYDVCWDIYSDRLVYCDAHL |
| 2159 | TLA389 | DYEVCWDLYLGRLYYCNAPI |
| 2160 | TLA390 | EYEVCWDVNVDRLVYCNMPN |
| 2161 | TLA391 | DYEVCWDVHFDRLVYCDTPL |
| 2162 | TLA393 | DYEVCWSDDLDRLVYCQALI |
| 2163 | TLA394 | DDAVCWDYHLDRLVFCETPM |
| 2164 | TLA395 | DYDVCWDIHLDRLVYCDGPL |
| 2165 | TLA396 | DYEVCWDVQLDRLVYCDGAM |
| 2166 | TLA397 | DYEVCWDVHVERLVYCEDLI |
| 2167 | TLA398 | DYAVCWDVYADRLIYCEVPM |
| 2168 | TLA399 | DYEVCWDFDIDRLVYCNPPM |
| 2169 | TLA402 | DYEVCWDVHLDRLVYCDGPL |
| 2170 | TLA403 | DYSVCWDFYDRLVYCNALF |
| 2171 | TLA404 | DYEVCWDVHVGRLIYCNALI |
| 2172 | TLA405 | SYDVCWDDVVDRLVYCEATL |
| 2173 | TLA406 | DYEVCWDVEVDRLVYCVGHK |
| 2174 | TLA407 | PYEVCWDFHLDRLVFCDADK |
| 2175 | TLA408 | DYEVCWDFLLDREVYCDAPI |
| 2176 | TLA409 | DWEVCWDVHLDRLVFCETLI |
| 2177 | TLA410 | DYEVCWDFDFDRLVFCEAVM |
| 2178 | TLA411 | DYDVCWDVNADRLVYCNATL |
| 2179 | TLA412 | NIIDVCWEFIILDRLVYCDGPS |
| 2180 | TLA413 | DYEVCWDVQLEHLVYCEAPI |
| 2181 | TLA415 | DDQVCWDVKIDRLVYCEALM |
| 2182 | TLA416 | HSDVCWDFDIDRLVFCDTLI |
| 2183 | TLA418 | DYEVCWDIHLDRLVYCNTPM |
| 2184 | TLA419 | DYDVCWDEDVDRLVYCEPPI |
| 2185 | TLA420 | DYEVCWDFDLDRLVYCDSDV |
| 2186 | TLA421 | DYEVCWDDHLDRLVYCDAPG |
| 2187 | TLA422 | DYDVCWDFDLDRLVYCSGPL |
| 2188 | TLA423 | DYEVCWDDHVDRLVYCDRTL |
| 2189 | TLA424 | DYEVCWDPHVDRLVYCDAPA |
| 2190 | TLA425 | IIYEVCWDAIIFDRLVYCEAPI |
| 2191 | TLA426 | DLEVCWDFDVDRLVYCEAPI |
| 2192 | TLA427 | GFEVCWDVDLDRLVFCAASE |
| 2193 | TLA428 | SYAVCWDFDLERLVYCEIPL |
| 2194 | TLA429 | DHEVCWDFELDRLVYCYKAK |
| 2195 | TLA430 | KYEVCWDEHIDRLVYCDVPM |
| 2196 | TLA431 | YSDVCWDFDLDRLVYCEAHL |
| 2197 | TLA432 | DYEVCWDVNLDRLVYCAGPM |
| 2198 | TLA433 | HYDVCWDDQVDRLVYCHAPL |
| 2199 | TLA434 | EYDVCWDFDIDRLVYCVPLS |
| 2200 | TLA435 | YYEVCWDLNLDRLVYCDVNK |
| 2201 | TLA436 | NYQVCWDFDLDRLVYCGAHK |
| 2202 | TLA437 | DYEVCWDVYFGRLVYCDVLM |
| 2203 | TLA438 | EYVVCWDTEVDHLVYCDAAM |
| 2204 | TLA439 | YSDVCWDFYYDRLVYCDASI |
| 2205 | TLA440 | DYEVCWDVDVDRLVYCDGPK |
| 2206 | TLA441 | DYAVCWDDHVEHLVYCDASW |
| 2207 | TLA442 | DYDVCWDFDFERLVFCNSSM |
| 2208 | TLA443 | DYAVCWDDHFDRLVYCDWTT |
| 2209 | TLA444 | DYDVCWDEHLDRLVYCNGLG |
| 2210 | TLA445 | EYEVCWDVNVDRLVWCYATM |
| 2211 | TLA446 | DYEVCWDVIIAERLYYCDAPI |
| 2212 | TLA447 | DHEVCWDEHVDRLVYCYKAI |
| 2213 | TLA448 | DYDVCWDDYLDRLVYCEARI |
| 2214 | TLA450 | HYDVCWDYHLDRLVYCNRHM |
| 2215 | TLA451 | DYEVCWDIHLDHLVYCDAPW |
| 2216 | TLA452 | EYDVCWDVDLDRLVYCATTY |
| 2217 | TLA453 | EYEVCWDFQVDRLVYCMAIT |

TABLE 16-continued

TL1A binding MRDs

| SEQ ID: | Ref. No. | Peptide Sequence |
|---|---|---|
| 2218 | TLA454 | DYEVCWDIIVDRLVYCEAPP |
| 2219 | TLA455 | YYEVCWDLYLDRLVFCNADL |
| 2220 | TLA457 | DYEVCWDFREDRLVYCDSIM |
| 2221 | TLA458 | DYAVCWDFHLNRLVYCDVPV |
| 2222 | TLA459 | EYDVCWDFQLDRLVYCDSQM |
| 2223 | TLA460 | DYAVCWDFDEDRLVYCVGPL |
| 2224 | TLA461 | SERDCNIQKMRKVPCLVML |
| 2225 | TLA464 | SDWACPMYMIIEIECSVRW |
| 2226 | TLA468 | VPEVCQWEFVKCLWNA |
| 2227 | TLA475 | AAWQCLDPEWWVCVMLN |
| 2228 | TLA485 | LVSSCPYGTPSAVCNGMW |
| 2229 | TLA489 | GTVYCQPYMSVMECAFRA |
| 2230 | TLA491 | EDFLCYPAPWVLSAAGT |
| 2231 | TLA493 | VSGGCPSYMNQWECVFRW |
| 2232 | TLA495 | HVELCFDKMRYCIMEL |
| 2233 | TLA519 | TLLACQLKFIKCLNNW |
| 2234 | TLA520 | LVFLCPGYRAQHHCVLLS |
| 2235 | TLA521 | QDRVCWDFHLQKLQFCELSM |

TABLE 17

EGFR binding MRDs

| SEQ ID: | Ref. No. | Peptide Sequence |
|---|---|---|
| 2252 | EGA43 | WEFQCHFYDESMFECTLSP |
| 2253 | EGA46 | WLSMCPHFYHQKCRFWK |
| 2254 | EGA47 | SRILCMVNPYWMACWLET |
| 2255 | EGA49 | GMRRCIWEYVMKHQACAPIF |
| 2256 | EGA50 | HLCGCYLELPGVLLCYCFS |
| 2257 | EGA51 | ARLLCVVYPGFVACVVQQ |
| 2258 | EGA54 | VAFRCIIDEMYYMTCWEVE |
| 2259 | EGA57 | GLIIGCQYVQMFFIIFCAPKT |
| 2260 | EGA58 | LLMFCHSMWWWPNCYSCV |
| 2261 | EGA67 | LSLRCTSEMWWGCYLVA |
| 2262 | EGA69 | EKMYCTYTHFFHMCYLPP |
| 2263 | EGA70 | LGVICIHWNYCKTFV |
| 2264 | EGA78 | SVLGCDDVGFYQCLEFL |
| 2265 | EGA81 | LLILCFHHQLEWKWTCLTME |
| 2266 | EGA85 | HSGQCTWEVWGRECWYQN |
| 2267 | EGA86 | QMDTCTWEVWGRDCIQWA |
| 2268 | EGA87 | DAWGCTWQVWGRECSDPG |
| 2269 | EGA88 | HEVGCTWEVWGRDCEQIR |
| 2270 | EGA90 | DPWGCTWEVWGRECPLNL |
| 2271 | EGA91 | DLHGCTWEIWGRECQIRH |
| 2272 | EGA92 | DPGGCTWEVWGRECQNSM |
| 2273 | EGA93 | DMFGCTWEVWGRECPSPQ |
| 2274 | EGA95 | DAWGCTWEIWGRECARSY |
| 2275 | EGA96 | TSDSCTWEIWGRECYMQR |
| 2276 | EGA98 | DQYGCTWEVWGRECVGGA |
| 2277 | EGA99 | DQYGCIWEQWGRECFVNT |
| 2278 | EGA100 | DNDGCTWEVWGRECHQFK |
| 2279 | EGA101 | EYDGCTWEVWGRECHESS |
| 2280 | EGA102 | GAGNCTWEIWGRDCPQDV |
| 2281 | EGA103 | TVDRCTWEVWGRECSQNG |
| 2282 | EGA104 | LADNCTWEVWGRECPITE |
| 2283 | EGA105 | DNYGCTWEVWGRDCSKSP |
| 2284 | EGA106 | DAHGCHWEVWGRECTRTA |
| 2285 | EGA107 | SSDLCTWEIWGRECYSGY |
| 2286 | EGA108 | DDFGCYWKGWGRECHLPL |
| 2287 | EGA109 | DWWGCTWEVWGRECLQLE |
| 2288 | EGA110 | DAHGCTWEVWGRECGQWA |
| 2289 | EGA111 | DAFGCTWEVWGRECRHVV |
| 2290 | EGA112 | DAWGCTWEIWGRDCAADN |
| 2291 | EGA113 | DASGCTWEVWGRECMMWH |
| 2292 | EGA114 | DPWACTWEVWGRECNHVG |
| 2293 | EGA115 | ASDNCTWEVWGRECQLWG |
| 2294 | EGA116 | DMYGCTWEIWGRECHIND |
| 2295 | EGA117 | DSWGCRWEVWGRECGSDI |
| 2296 | EGA118 | NPDGCTWEVWGRECYSNR |
| 2297 | EGA119 | DFFGCTWEIWGRECYWEF |
| 2298 | EGA120 | SSSFCTWEVWGRDCPQDQ |
| 2299 | EGA121 | AADRCTWEVWGRDCPQTH |
| 2300 | EGA122 | LVDLCTWEVWGRECWYSD |
| 2301 | EGA124 | DSYGCTWEVWGRECPMDT |
| 2302 | EGA125 | DNWGCTWEVWGRDCHYGT |
| 2303 | EGA126 | PDFGCTWEVWGRECYGVN |

TABLE 17-continued

EGFR binding MRDs

| SEQ ID: | Ref. No. | Peptide Sequence |
|---|---|---|
| 2304 | EGA128 | QSTQCTWEVWGRECHQMR |
| 2305 | EGA129 | LPPGCTWEVWGRDCLHPR |
| 2306 | EGA130 | GEVDCTWEVWGRECYNGW |
| 2307 | EGA131 | LTVGCTWEVWGRECWQQP |
| 2308 | EGA132 | DDDGCTWEVWGRECRLPA |
| 2309 | EGA133 | SLLSCTWEVWGRDCSAFY |
| 2310 | EGA134 | KDKECTWEVWGRECWQDR |
| 2311 | EGA135 | DQGGCTWQVWGRDCRSNP |
| 2312 | EGA136 | DHYGCTWEVWGRECWTVG |
| 2313 | EGA137 | DAFGCTWAVWGRECRHDQ |
| 2314 | EGA138 | YGDSCTWEVWGRECMMGR |
| 2315 | EGA139 | TADPCTWEVWGRECHMRP |
| 2316 | EGA140 | QDWGCTWEVWGRDCQQYT |
| 2317 | EGA141 | DSWGCTWEIWGRECWGTE |
| 2318 | EGA142 | SVDFCTWEVWGRECYWYP |
| 2319 | EGA143 | AGDGCTWEVWGRECLQES |
| 2320 | EGA144 | MWPNCTWEVWGRDCAWYH |
| 2321 | EGA145 | DEYGCSWEVWGRECHTTL |
| 2322 | EGA146 | DQWGCTWEVWGRECAFNS |
| 2323 | EGA147 | SSDPCTWEVWGRECPQGP |
| 2324 | EGA148 | LVLGCWWEVWGRECGSTA |
| 2325 | EGA149 | KADHCTWEIWGRECAQYT |
| 2326 | EGA150 | DDWGCSWEVWGRECQIPK |
| 2327 | EGA151 | PKYGCTWEIWGRECWHST |
| 2328 | EGA153 | SNLGCTWELWGRDCSLYY |
| 2329 | EGA154 | DAYGCYWELWGRDCHQIV |
| 2330 | EGA155 | DYWGCTWEVWGRECTTNP |
| 2331 | EGA156 | DIWNCTWEVWGRECYLNQ |
| 2332 | EGA157 | SWSLCTWEVWGRDCYWQK |
| 2333 | EGA158 | DIWGCTWEVWGRECENYY |
| 2334 | EGA159 | TNGFCTWEVWGRECWYGS |
| 2335 | EGA160 | DLYGCTWEIWGRECHITG |
| 2336 | EGA161 | DENGCTWEVWGRECYIQR |
| 2337 | EGA162 | DSFGCTWEVWGRECHPQL |
| 2338 | EGA163 | NHDFCTWEVWGRECWPNA |
| 2339 | EGA164 | DEHGCTWEVWGRECHRPG |
| 2340 | EGA165 | DHHGCTWEVWGRDCYWAI |
| 2341 | EGA166 | WQDNCWWEVWGRECLGDR |
| 2342 | EGA167 | PTDTCTWEVWGRECYWIR |
| 2343 | EGA168 | YQDPCTWEIWGRDCHQGM |
| 2344 | EGA169 | DRWGCTWEIWGRECHQDN |
| 2345 | EGA170 | DLWGCTWEVWGRECFVVN |
| 2346 | EGA171 | GLDGCTWEVWGRECYQGS |
| 2347 | EGA173 | LPIPCYWTTWGKECFMPR |
| 2348 | EGA174 | LPDPCYWTTWGKECFMFR |
| 2349 | EGA175 | LADPCYWTTWGKECVIPR |
| 2350 | EGA176 | LTVPCYWTTWGKECFLPR |
| 2351 | EGA177 | LPAPCYWTTWGKECFILR |
| 2352 | EGA178 | LPAPCYWTTWGKECHMPR |
| 2353 | EGA179 | LPAPCFWTTWGKECFLFR |
| 2354 | EGA180 | LAAPCYWTTWGKECYMPR |
| 2355 | EGA181 | PTSPCYWTTWGKECYLLR |
| 2356 | EGA182 | ITPPCYWTSWGKECHLFR |
| 2357 | EGA183 | LPAPCYWTTWGKECFMLR |
| 2358 | EGA184 | LTEPCYWTTWGKECFLPV |
| 2359 | EGA185 | LPAGCYWTTWGKECFMHN |
| 2360 | EGA186 | ITSPCYWTTWGKECFIFP |
| 2361 | EGA187 | LPAPCYWTTWGKECLLFG |
| 2362 | EGA188 | LPAPCYWTTWGKECFMPQ |
| 2363 | EGA189 | LPAPCYWTTWGKECFILS |
| 2364 | EGA190 | LPTPCYWTTWGKECYVYG |
| 2365 | EGA192 | LPAPCYWTTWGKECYMLP |
| 2366 | EGA193 | LTPPCYWTTWGKECFMFP |
| 2367 | EGA194 | LSTQCYWTTWGKECYLFP |
| 2368 | EGA195 | LPAPCYWTTWGKECLMLR |
| 2369 | EGA196 | LPYPCYWTTWGKECFMHR |
| 2370 | EGA197 | LAAPCYWTTWGKECLMIR |
| 2371 | EGA198 | LTAPCYWTTWGKECYLFH |
| 2372 | EGA199 | LPAPCYWTTWGKECVLGV |
| 2373 | EGA200 | LPFPCYWTVWGKECFMPR |
| 2374 | EGA202 | LSPPCYWTIWGKECHMEQ |
| 2375 | EGA203 | PNDPCYWTTWGRECLLGR |
| 2376 | EGA204 | LPPPCYWTTWGKECQMFD |
| 2377 | EGA205 | LTDPCYWTIWGRECLLPS |
| 2378 | EGA206 | FNEPCYWTTWGKECYLPR |

TABLE 17-continued

EGFR binding MRDs

| SEQ ID: | Ref. No. | Peptide Sequence |
|---|---|---|
| 2379 | EGA207 | LPAPCYWTNWGKECFMMR |
| 2380 | EGA208 | FPDPCYWTTWGRECLLPR |
| 2381 | EGA209 | VTSGCYWTTWGKECFLPR |
| 2382 | EGA210 | STAACYWTTWGKECYMPR |
| 2383 | EGA211 | LPGGCYWTTWGKECFMPR |
| 2384 | EGA212 | IITPCYWTTWGKECYLIP |
| 2385 | EGA213 | TADPCYWTIWGRECVMSR |
| 2386 | EGA215 | LADQCYWTTWGKECYLGL |
| 2387 | EGA216 | LTDPCYWTVWGRECFLLR |
| 2388 | EGA217 | IDAACYWTTWGKECLLPR |
| 2389 | EGA218 | LTAPCYWTTWGKECFLLR |
| 2390 | EGA219 | LPVPCYWTTWGKECLMLR |
| 2391 | EGA220 | VTDSCYWTTWGRECYLPH |
| 2392 | EGA221 | LPAGCYWTTWGKECYMFA |
| 2393 | EGA222 | FTDPCYWTVWGRECLLPR |
| 2394 | EGA223 | LTAPCYWTTWGKECLILR |
| 2395 | EGA224 | VTDPCYWTTWGRECLMLP |
| 2396 | EGA225 | LTSPCYWTTWGKECFMLN |
| 2397 | EGA226 | LPVPCYWTTWGKECLMFP |
| 2398 | EGA227 | TADPCYWTTWGRECLMPR |
| 2399 | EGA228 | LTAPCYWTIWGKECYLLP |
| 2400 | EGA229 | LAPPCYWTIWGKECLLLR |
| 2401 | EGA230 | LPSPCYWTTWGKECFMPR |
| 2402 | EGA231 | VTDGCYWTTWGKECLMPR |
| 2403 | EGA233 | LPDDCYWTTWGKECYLQR |
| 2404 | EGA235 | DIDPCWWAPWGRECLMVR |
| 2405 | EGA236 | TPDPCWWATWGRECILDR |
| 2406 | EGA237 | LPAPCFWTTWGKECFLLR |
| 2407 | EGA238 | DNDPCYWTVWGRECLMPL |
| 2408 | EGA239 | LTAPCYWTTWGKECLLLP |
| 2409 | EGA240 | LTVPCYWTTWGKECYLLS |
| 2410 | EGA241 | LIAPCYWTTWGKECYMLP |
| 2411 | EGA242 | LPEPCYWTTWGKECFLPR |
| 2412 | EGA243 | LTTPCYWTIWGKECFLPI |
| 2413 | EGA244 | LPEGCYWTTWGKECFMLR |
| 2414 | EGA245 | LPAPCYWTTWGKECFILL |
| 2415 | EGA247 | LKAPCYWTTWGKECYLLP |
| 2416 | EGA248 | LKDPCYWTTWGRECLMLP |
| 2417 | EGA249 | VRPGCYWTTWGKECFMPG |
| 2418 | EGA250 | PSDPCYWTIWGRECYMIP |
| 2419 | EGA251 | LPAPCYWTVWGKECHMSR |
| 2420 | EGA252 | LSDPCYWTIWGKECFLIL |
| 2421 | EGA254 | LTDHCYWTIWGRECLLPR |
| 2422 | EGA255 | VTDPCYWTTWGRECLLLR |
| 2423 | EGA256 | LPAGCYWTTWGKECHLHL |
| 2424 | EGA257 | LPAPCFWTTWGKECYMFT |
| 2425 | EGA258 | FSDPCYWTTWGRECFWIP |
| 2426 | EGA259 | LSDPCYWTTWGRECFLLP |
| 2427 | EGA260 | FKDPCYWTTWGRECYLLP |
| 2428 | EGA261 | FPDPCYWTTWGRECTLPL |
| 2429 | EGA262 | LTDPCHWTIWGRECFLPP |
| 2430 | EGA263 | YDDHCCYLTIWGRECFLPP |
| 2431 | EGA265 | FSDPCIWTTWGRECFWVH |
| 2432 | EGA266 | TRDTCYWTVWGRECFLPP |
| 2433 | EGA268 | HRAPCFSCTACRQPCFSLT |
| 2434 | EGA269 | FDDPCYWTTWGRECLMLP |
| 2435 | EGA270 | HNDPCVWTTWGRECFLLP |
| 2436 | EGA271 | LGDSCFWTTWGRECFLHP |
| 2437 | EGA272 | FSDPCYWTTWGRECLLIP |
| 2438 | EGA273 | CTGPCYWTTWGRECCLSYP |
| 2439 | EGA274 | ASDPCYWTTWGRECFLLP |
| 2440 | EGA276 | LSDPCYWTTWGRECILLQ |
| 2441 | EGA277 | LTDPCHWTIWGRECFLLP |
| 2442 | EGA278 | STDLCYWTIWGRECYLPP |
| 2443 | EGA279 | FSDPCSWTTWGRECFLPP |
| 2444 | EGA280 | WRDPCYWATWGRECYLVP |
| 2445 | EGA281 | LGDPCYWTTWGRECFWLP |
| 2446 | EGA282 | FRDPCYWTTWGRECFLLP |
| 2447 | EGA283 | LIDPCYWTTWGRECFLIP |
| 2448 | EGA284 | LSDNCYWTTWGRECFLPP |
| 2449 | EGA285 | FTDPCYWTTWGRECFLLP |
| 2450 | EGA286 | YNDPCYWTTWGRECLLLP |
| 2451 | EGA287 | SSDPCYWTTWGRECFLLP |
| 2452 | EGA288 | FGDPCYWTTWGRECYLLRP |
| 2453 | EGA289 | LTDPCWWTTWGRECLLLP |

TABLE 17-continued

EGFR binding MRDs

| SEQ ID: | Ref. No. | Peptide Sequence |
|---|---|---|
| 2454 | EGA290 | SSDPCYWTTWGRECLLLP |
| 2455 | EGA291 | LSDPCYWTTWGRECLLLP |
| 2456 | EGA292 | FRDPCYWTTWGRECFLPP |
| 2457 | EGA293 | FDDYCCYWATWGRECYLIP |
| 2458 | EGA294 | YSGPCYWTTWGRECILHP |
| 2459 | EGA296 | SSDACYWTTWGRECFLLP |
| 2460 | EGA297 | FSDHCWWSTWGRECYLLP |
| 2461 | EGA298 | TSDPCYWTTWGRECLLNR |
| 2462 | EGA299 | TSDPCYWTTWGRECLLLP |
| 2463 | EGA300 | CSGPCYWTTWGRECCFSLP |
| 2464 | EGA302 | SIDSCFWTTWGRECFLLP |
| 2465 | EGA303 | FSDPCYWTTWGRECFLVQ |
| 2466 | EGA304 | FSDPCYWTTWGRECFETP |
| 2467 | EGA305 | CRDPCYWTTWGRECYLIP |
| 2468 | EGA307 | FGDPCYWATWGRECFLIP |
| 2469 | EGA308 | FADPCYWTTWGRECLLHP |
| 2470 | EGA309 | FSEPCYWTIWGRECYLLP |
| 2471 | EGA310 | DDDDCYWTTWGRECFLLP |
| 2472 | EGA311 | FSDPCTWTTWGRECFLFS |
| 2473 | EGA313 | FGDPCSWTIWGRECFLLP |
| 2474 | EGA314 | SKDPCYWTTWGRECFLLP |
| 2475 | EGA315 | CTGPCYWTTWGRECCFFVP |
| 2476 | EGA316 | FSDPCYWTTWGRECYLRP |
| 2477 | EGA318 | YSDPCYWTTWGRECFLMP |
| 2478 | EGA319 | FGDPCYWTTWGRECFLLP |
| 2479 | EGA321 | LTDPCYWTTWGRECFLLP |
| 2480 | EGA322 | YIDTCYWTTWGRECFELP |
| 2481 | EGA323 | FSDPCFWTTWGRECFWVH |
| 2482 | EGA324 | FSDHATGQHGVESAFCF |
| 2483 | EGA325 | FNDPCIWTTWGRECFLLP |
| 2484 | EGA326 | VSDPCYWTIWGRECFLLP |
| 2485 | EGA327 | ISDPCYWTTWGRECFLLP |
| 2486 | EGA328 | FSDPCYWTTWGRECFWVP |
| 2487 | EGA329 | SRDPCHWTTWGRECLLLP |
| 2488 | EGA330 | FSEPCYWTIWGRECFLLP |
| 2489 | EGA331 | VIDTCYWTTWGRECYLLPP |
| 2490 | EGA333 | ITDPCYWTTWGRECFLRP |
| 2491 | EGA335 | PSDPCHWTTWGRECFLQS |
| 2492 | EGA336 | FTDPCYWTIWGRECYLDP |
| 2493 | EGA337 | FSDHCWWTTWGRECLLLP |
| 2494 | EGA338 | FSDPCIWTTWGRECFWVP |
| 2495 | EGA339 | FDDIICCYWTTWGRECFRLP |
| 2496 | EGA340 | FTDPCYWTIWGRECYEDT |
| 2497 | EGA341 | SIDPCYWTTWGRECFFLP |
| 2498 | EGA342 | FADPCYWTIWGRECFLLP |
| 2499 | EGA344 | FSDPCYWTTWGKECFLLH |
| 2500 | EGA346 | AFWQCVYTPMHAMCFSHK |
| 2501 | EGA347 | MTIHWCQPWGCLLLFG |
| 2502 | EGA350 | LYLSCMTGWWGEIVCVSAS |
| 2503 | EGA351 | KGLDCVHWPGMHWCWRSD |
| 2504 | EGA352 | FSDPCYWTIWGRECFLFP |
| 2505 | EGA354 | FLDPCFWTIWGRECYLLP |
| 2506 | EGA355 | FTDPCHWTTWGRECIWLP |
| 2507 | EGA356 | WRAYCHHSPWDFECFQVW |
| 2508 | EGA358 | VGDPCSWTTWGRECFLFD |
| 2509 | EGA359 | FSDPCVWTTWGRECLLLP |
| 2510 | EGA362 | WSPRCFAWIVCLDLS |
| 2511 | EGA370 | YKWVCMWTPFGHQCVSAA |
| 2512 | EGA374 | LGDPCYWTTWGRECVLLP |
| 2513 | EGA375 | KKVFCYYLPFQQYCVTVS |
| 2514 | EGA376 | FVTWCYAWPDSSACYGLH |
| 2515 | EGA377 | FSDPCYWTTWGRECFMPP |
| 2516 | EGA378 | YSDPCYWTTWGRECLLLP |
| 2517 | EGA379 | WFVTCSFQFEWECVQLH |
| 2518 | EGA380 | PDSWCHTLYWQLLHCEMSE |
| 2519 | EGA381 | VDSWCHTLYWQLHYCASQE |
| 2520 | EGA382 | ADSWCHTLYWSLLHCASSE |
| 2521 | EGA383 | PDSGCHTLYWNLQHCASLE |
| 2522 | EGA384 | ADSWCHTLYWQLYYCESLE |
| 2523 | EGA386 | PESWCHTLYWSLQDCVSSE |
| 2524 | EGA387 | PDSWCHTLYWQLHHCLSSE |
| 2525 | EGA388 | ADSWCHTLYWQLLHCVTQE |
| 2526 | EGA389 | ADSWCHTLYWSLLECESRE |
| 2527 | EGA390 | PDSWCHTLFWDLQHCVSGE |
| 2528 | EGA391 | PDSLCHTLYWSLRHCEIEE |

TABLE 17-continued

EGFR binding MRDs

| SEQ ID: | Ref. No. | Peptide Sequence |
|---|---|---|
| 2529 | EGA392 | PDSLCHTLYWQLQHCAFWE |
| 2530 | EGA393 | ADSWCIITLYWQLYYCEVWE |
| 2531 | EGA394 | AESWCHTLYWSLHHCVYSE |
| 2532 | EGA395 | TDSWCHTLYWNLLHCASYE |
| 2533 | EGA396 | PDSWCHTLYWQLLHCATLE |
| 2534 | EGA397 | PDSWCHTLYWLLHECESRE |
| 2535 | EGA398 | PDSWCHTLYWSLQFCESSE |
| 2536 | EGA399 | PDSWCHTLYWQLHHCEILE |
| 2537 | EGA400 | PDSWCHTLYWKLHHCLSME |
| 2538 | EGA401 | VDSWCHTLYWQLLHCAMSE |
| 2539 | EGA402 | AESWCHTLYWQLVHCTSLE |
| 2540 | EGA403 | PDSWCHTLYWDLLHCESSE |
| 2541 | EGA404 | ADSWCIITLWWQLIIICLFEE |
| 2542 | EGA405 | TDSWCHTLYWLLHDCTSRE |
| 2543 | EGA407 | ADSWCHTLYWQLLHCVAQE |
| 2544 | EGA408 | PDSSCHTLYWLLEHCLSVE |
| 2545 | EGA409 | PDSWCHTLYWQLHYCTILE |
| 2546 | EGA410 | PDSWCHTLYWQLLHCEISE |
| 2547 | EGA411 | PDSWCHTLYWQLLHCAASE |
| 2548 | EGA412 | PDSWCHTLYWQLHHCVSWE |
| 2549 | EGA413 | TDSWCHTLYWALQHCVSTE |
| 2550 | EGA414 | PDSWCHTLYWQLLHCTTQE |
| 2551 | EGA415 | ADSWCHTLYWQLLHCISLE |
| 2552 | EGA416 | ADSWCHTLYWQLQHCLSQE |
| 2553 | EGA417 | PDSYCHTLYWSLIHCARSE |
| 2554 | EGA418 | TDSWCHTLYWELQYCLMQE |
| 2555 | EGA419 | TDSWCHTLYWQLHHCAILE |
| 2556 | EGA420 | PDSWCHTLYWQLYHCVSLE |
| 2557 | EGA421 | ADSWCHTLYWQLLHCVNQE |
| 2558 | EGA422 | PDSWCHTLYWSLLHCARQE |
| 2559 | EGA423 | ADSWCHTLYWALQHCARSE |
| 2560 | EGA424 | ADSWCHTLYWSLLHCASED |
| 2561 | EGA425 | ADSWCHTLYWDLLHCANLE |
| 2562 | EGA426 | ADSWCIITLYWQLLIICESSE |
| 2563 | EGA427 | PDSWCHTLYWDLLHCPAGE |
| 2564 | EGA428 | ADSWCHTLYWQLHHCTSLE |
| 2565 | EGA429 | ADSWCHTLYWSLQHCASSE |
| 2566 | EGA430 | PDSWCHTLYWQLYHCEMSE |
| 2567 | EGA431 | PDSWCHTLYWDLMHCHHEE |
| 2568 | EGA432 | PDSWCHTLYWQLYYCATSE |
| 2569 | EGA434 | ADSWCHTLYWQLLHCASGE |
| 2570 | EGA435 | ADSWCHTLYWQLYHCAYWE |
| 2571 | EGA436 | TDSWCHTLYWSLAHCAFLE |
| 2572 | EGA437 | ADSWCHTLYWQLLHCETLE |
| 2573 | EGA438 | ADSWCHTLYWQLHHCVSLE |
| 2574 | EGA439 | ADSWCHTLYWDLLHCESLE |
| 2575 | EGA440 | ADSWCHTLYWQLLHCEFSE |
| 2576 | EGA441 | TDSWCIITLYWNLVIICASQD |
| 2577 | EGA442 | PDSWCHTLYWDLLYCVNQE |
| 2578 | EGA443 | PDSWCHTLYWNLHHCLSME |
| 2579 | EGA444 | ADSWCHTLYWALHHCSIQE |
| 2580 | EGA445 | TDSWCHTLYWALQHCVAQE |
| 2581 | EGA446 | PDSRCHTLYWALRYCAYQE |
| 2582 | EGA447 | ADSWCHTLYWNLLYCAIRE |
| 2583 | EGA448 | VDSFCHTLYWQLIHCPIEE |
| 2584 | EGA449 | ADSWCHTLYWNLLHCRALE |
| 2585 | EGA450 | PDSWCHTLYWQLLDCATRE |
| 2586 | EGA451 | ADSWCHTLYWNLRHCEIQE |
| 2587 | EGA452 | PNSWCIITLYWDLLIICVSRE |
| 2588 | EGA453 | ADSWCHTLYWQLHHCAISE |
| 2589 | EGA454 | ADSWCHTLYWSLLHCESFD |
| 2590 | EGA455 | ADSWCHTLYWQLQHCVSWE |
| 2591 | EGA456 | ADSWCHTLYWQLQHCISYE |
| 2592 | EGA457 | PDSWCHTLYWSLQHCAIYE |
| 2593 | EGA458 | PDSWCHTLYWQLLDCTSSE |
| 2594 | EGA459 | PDSWCHTLYWHLQHCLSQE |
| 2595 | EGA460 | AESWCHTLYWSLYHCASEE |
| 2596 | EGA461 | PDSWCHTLYWQLQHCVSWE |
| 2597 | EGA462 | ADSWCHTLYWQLLHCVSQE |
| 2598 | EGA463 | ADSWCHTLYWQLQYCVMQE |
| 2599 | EGA465 | ADSWCHTLYWQLLHCESLE |
| 2600 | EGA468 | ADSWCHTLYWQLHHCVLEE |
| 2601 | EGA469 | PDSWCHTLYWSLHHCLISE |
| 2602 | EGA470 | PDSWCHTLYWQLIHCERQE |
| 2603 | EGA471 | PDSWCHTLYWNLQHCERME |

TABLE 17-continued

EGFR binding MRDs

| SEQ ID: | Ref. No. | Peptide Sequence |
|---|---|---|
| 2604 | EGA472 | ADSWCHTLYWQLKHCEFTE |
| 2605 | EGA473 | ADSWCHTLYWNLLYCANQE |
| 2606 | EGA474 | PDSWCHTLYWSLQHCLNME |
| 2607 | EGA475 | PDSWCHTLYWSLYHCTISD |
| 2608 | EGA476 | ADSWCIITLWWQLLIICESGE |
| 2609 | EGA477 | SDSWCHTLYWSLRHCESLE |
| 2610 | EGA478 | ADSWCHTLYWDLQHCLRWE |
| 2611 | EGA479 | PDSWCHTLYWQLLYCESWE |
| 2612 | EGA480 | ANSWCHTLFWDLHHCLSLE |
| 2613 | EGA481 | ADSWCHTLYWQLYHCTSLE |
| 2614 | EGA482 | PDSWCHTLYWQLRHCEISE |
| 2615 | EGA484 | PDSGCHTLYWSLQHCTFWE |
| 2616 | EGA485 | ADSWCHTLYWQLYHCEVLE |
| 2617 | EGA486 | PDSWCHTLYWDLHWCVSLE |
| 2618 | EGA487 | ADSWCHTLYWSLLHCAIGE |
| 2619 | EGA489 | ADSWCHTLYWQLHHCLWLE |
| 2620 | EGA490 | ADSWCHTLYWSLAHCLSGE |
| 2621 | EGA491 | AESWCHTLYWDLHYCVYHE |
| 2622 | EGA492 | SDSWCIITLYWSLQIICVISE |
| 2623 | EGA493 | ADSWCHTLYWNLLHCEYRE |
| 2624 | EGA494 | ADSWCHTLYWQLLHCASEE |
| 2625 | EGA495 | PESWCHTLYWQMIFCESFE |
| 2626 | EGA496 | ANSWCHTLYWQLHHCEILE |
| 2627 | EGA497 | PDSWCHTLYWALHHCASSE |
| 2628 | EGA498 | PDSSCHTLYWQLHHCARRE |
| 2629 | EGA499 | ADSWCHTLYWDLQHCLILE |
| 2630 | EGA500 | ADSWCHTLFWNLKHCLIQE |
| 2631 | EGA502 | ANSWCHTLYWDLMYCVWQE |
| 2632 | EGA503 | ADSWCHTLYWQLHHCVTLE |
| 2633 | EGA504 | PDSWCIITLYWALIIIICVSSE |
| 2634 | EGA505 | GGSGCHGYLWQLLHCETWEG QAGQAAAGGSTDSWCHTLYW QLYHCASSE |
| 2635 | EGA506 | PESWCHTLYWNLQHCLSGE |
| 2636 | EGA507 | PDSWCHTLYWQLTHCESLE |
| 2637 | EGA509 | PDSWCIITLYWVLLDCARIIE |
| 2638 | EGA510 | PDSWCHTMYWSLIHCMNME |
| 2639 | EGA511 | AASWCQALYWHQFCCASWE |
| 2640 | EGA514 | ADSWCHTLFWQLQHCVWQE |
| 2641 | EGA515 | TDSWCHTLYWSLLHCESLG |
| 2642 | EGA517 | PDSWCHTLYWQLYHCLSLE |
| 2643 | EGA519 | SPDSCWWAIWGKECILLP |
| 2644 | EGA520 | LSSGCYWAVWGRECLLIP |
| 2645 | EGA521 | LADGCWWAAWGRECLLPP |
| 2646 | EGA522 | LPGGCWWSAWGRECILLP |
| 2647 | EGA523 | LPEGCWWAVWGRECQLQP |
| 2648 | EGA524 | LPEGCWWSTWGRECLLLP |
| 2649 | EGA526 | LPEGCYWAIWGKECFLPP |
| 2650 | EGA527 | LPDGCWWAQWGRECLLLP |
| 2651 | EGA528 | DPDGCHWEVWGRECILLP |
| 2652 | EGA529 | LPEGCWWATWGRECLLPP |
| 2653 | EGA530 | LPDGCWWSLWGRECFLPP |
| 2654 | EGA531 | LLDVCWWSTWGRECLLQP |
| 2655 | EGA532 | LPEGCWWAHWGRECVMVP |
| 2656 | EGA533 | LPDDCYWAQWGRECHMLP |
| 2657 | EGA534 | LPEGCYWAVWGRECILPR |
| 2658 | EGA535 | VPEGCWWSPWGRECLLPP |
| 2659 | EGA536 | LPSGCWWAVWGKECLLLP |
| 2660 | EGA537 | MPEGCWWSLWGRECMLLP |
| 2661 | EGA538 | LPEGCWWATWGKECLLLP |
| 2662 | EGA539 | LPEGCYWAIWGKECYLQA |
| 2663 | EGA540 | LPEGCWWATWGRECFLLP |
| 2664 | EGA541 | PPDGCWWAVWGRECLLLP |
| 2665 | EGA542 | LPESCWWSPWGRECLLPP |
| 2666 | EGA543 | LSEGCWWAVWGKECTLPP |
| 2667 | EGA544 | LSEGCWWAVWGRECLLQP |
| 2668 | EGA545 | LPVGCWWSVWGRECLLPP |
| 2669 | EGA546 | VPAGCWWAPWGRECILSP |
| 2670 | EGA547 | LPSACNWSPWSWQCFWLP |
| 2671 | EGA548 | LPEGCWWAVWGKECVLSP |
| 2672 | EGA550 | LPEGCWWSSWGKECFLHP |
| 2673 | EGA551 | LPDGCWWSPWGRECILLP |
| 2674 | EGA552 | LPDGCWWAVWGRECILPP |
| 2675 | EGA553 | LPEGCWWATWGKECVLLP |
| 2676 | EGA555 | LPDGCWWSAWGKECFLLP |
| 2677 | EGA556 | LPEGCWWSVWGKECLLLP |

TABLE 17-continued

EGFR binding MRDs

| SEQ ID: | Ref. No. | Peptide Sequence |
|---|---|---|
| 2678 | EGA557 | LPEGCWWAIIWGRECLLQP |
| 2679 | EGA558 | FPERCWWAMWGKECYLLP |
| 2680 | EGA559 | LPEGCWWTVWGKECYLLP |
| 2681 | EGA560 | LSADCWWSPWGRECILKP |
| 2682 | EGA561 | PSQGCWWSVWGRECFLPP |
| 2683 | EGA562 | FPEECWWATWGRECFLPR |
| 2684 | EGA563 | FPEGCWWATWGKECLLRP |
| 2685 | EGA564 | LPDGCWWALWGKECFLMH |
| 2686 | EGA565 | LPEGCYWAQWGKECFLVP |
| 2687 | EGA566 | LADSCYWTIWGRECLLPP |
| 2688 | EGA567 | FPADCWWSTWGRECFLQP |
| 2689 | EGA568 | LPEGCYWAVWGRECYLVP |
| 2690 | EGA569 | LPEGCWWAVWGRECLLLP |
| 2691 | EGA570 | DPEGCFWAVWGRECLLQP |
| 2692 | EGA571 | FADGCWWEVWGRECLLLP |
| 2693 | EGA572 | DPEGCWWAVWGRECLLRP |
| 2694 | EGA573 | VSEGCWWAIWGRECILLP |
| 2695 | EGA574 | LPEGCWWSPWGKECLMTP |
| 2696 | EGA575 | LPDGCWWALWGKECILRP |
| 2697 | EGA576 | LPDGCWWSQWGRECILVP |
| 2698 | EGA577 | LPQDCWWAIWGRECFMLP |
| 2699 | EGA578 | LPDVCWWAVWGRECLLMP |
| 2700 | EGA579 | LPEGCWWAKWGKECVLPS |
| 2701 | EGA580 | LPEGCYWTIWGRECFLFP |
| 2702 | EGA581 | LPESCWWAVWGRECLLSP |
| 2703 | EGA582 | SPDGCWWSQWGRECIMLP |
| 2704 | EGA583 | KPESCWWANWGRECLLLP |
| 2705 | EGA584 | LSEGCWWATWGKECLLLP |
| 2706 | EGA585 | VAGGCWWATWGRECLLPP |
| 2707 | EGA586 | SAEGCWWAVWGRECLLLP |
| 2708 | EGA587 | LPEGCYWAIWGRECLLPR |
| 2709 | EGA588 | LPEGCFWAVWGKECFLLP |
| 2710 | EGA589 | LTEGCWWAQWGRECILLP |
| 2711 | EGA590 | LPKGCFWTTWGKECLLLP |
| 2712 | EGA591 | LPEGCWWTVWGRECLLLP |
| 2713 | EGA592 | LPDDCWWAPWGRECFLRP |
| 2714 | EGA594 | DSDGCYWAVWGRECFFLP |
| 2715 | EGA595 | LRDGCWWAIWGRKCLLLP |
| 2716 | EGA596 | VDEGCWWAVWGRECVLPE |
| 2717 | EGA597 | HTDGCWWAQWGRECLLVP |
| 2718 | EGA598 | LPEGCWWAPWGKECLLLP |
| 2719 | EGA599 | LPDGCWWASWGRECFLIP |
| 2720 | EGA600 | LPEGCWWAVWGRECILLS |
| 2721 | EGA601 | LPDACWWSVWGKECILEP |
| 2722 | EGA602 | DPHGCWWSPWGRECVLLD |
| 2723 | EGA603 | LPQGCYWAVWGRECLLPL |
| 2724 | EGA604 | LDAPCYWTVWGKECFLFS |
| 2725 | EGA605 | DHYGCYWTQWGRECFPMY |
| 2726 | EGA606 | LPEGCYWAVWGKECFLLP |
| 2727 | EGA607 | LHEGCWWAVWGKECFLLP |
| 2728 | EGA608 | LPEGCWWSKWGRECILVP |
| 2729 | EGA609 | LPQGCWWANWGRECFLLP |
| 2730 | EGA610 | LPEGCWWATWGRECILLP |
| 2731 | EGA611 | ISDGCWWAIWGRECLLMP |
| 2732 | EGA612 | TPDGCYWAVWGRECFLRP |
| 2733 | EGA613 | LPGDCWWAIWGRECLLPP |
| 2734 | EGA614 | FADGCWWAVWGRECFWEP |
| 2735 | EGA615 | LPEGCWWAVWGKECFMLP |
| 2736 | EGA616 | LPEGCWWSTWGKECVLLP |
| 2737 | EGA617 | LPDGCWWSLWGKECHLLQ |
| 2738 | EGA618 | LPEGCWWAHWGKECQLRP |
| 2739 | EGA619 | DPEGCWWATWGRECLLLP |
| 2740 | EGA620 | LPDGCWWAHWGRECLLPP |
| 2741 | EGA621 | LPDGCWWAKWGKECLLWP |
| 2742 | EGA622 | LPDGCWWSVWGKECILLP |
| 2743 | EGA624 | RSEGCWWATWGRECFLHP |
| 2744 | EGA627 | LPEVCWWATWGHECLLLP |
| 2745 | EGA628 | LPEGCWWSSWGRECFLLP |
| 2746 | EGA629 | LPEGCYWATWGKECLLQP |
| 2747 | EGA630 | LPQGCWWATWGRECLLRP |
| 2748 | EGA631 | LPDGCWWAVWGRECLLLP |
| 2749 | EGA632 | VSEGCWWAIWGRECFLQP |
| 2750 | EGA633 | VADGCVWMVWGRECLLLP |
| 2751 | EGA634 | VPEACWWALWGRECILRP |
| 2752 | EGA635 | LPQGCYWTVWGRECLLVP |

TABLE 17-continued

EGFR binding MRDs

| SEQ ID: | Ref. No. | Peptide Sequence |
|---|---|---|
| 2753 | EGA636 | QPEYCWWATWGRECLLVP |
| 2754 | EGA637 | LPEGCFWAIWGSECLLLP |
| 2755 | EGA638 | LPEACWWSTWGRECLLLP |
| 2756 | EGA639 | VPEGCWWAVWGVECQLLP |
| 2757 | EGA640 | LPESCCWTDWGHECFLPP |
| 2758 | EGA641 | FPEDCWWSVWGRECLLLP |
| 2759 | EGA642 | LSGGCWWAVWGRECLLLP |
| 2760 | EGA643 | LPDCWWSQWGRECILLP |
| 2761 | EGA644 | MPEGCWWAAWGRECILLP |
| 2762 | EGA645 | LPEGCYWAVWGRECLLLP |
| 2763 | EGA646 | LPDGCYWAIWGRECILPN |
| 2764 | EGA647 | LPEGCWWAIWGRECLLLP |
| 2765 | EGA648 | LPEGCWWATWGRECLLLP |
| 2766 | EGA650 | LPEGCYWTTWGKECLLRP |
| 2767 | EGA651 | LPDGCYWAVWGKECYQIR |
| 2768 | EGA652 | LPEGCWWSSWGKECFLLP |
| 2769 | EGA654 | LPEGCWWAHWGKECLLGP |
| 2770 | EGA655 | IPDGCWWTVWGRECFLIIP |
| 2771 | EGA656 | LPEGCWWSIWGRECILLP |
| 2772 | EGA657 | LPEGCHWTMWGKECFLPP |
| 2773 | EGA658 | LPEGCWWATWGRECILPP |
| 2774 | EGA659 | LPEGCWWAPWGKECILPH |
| 2775 | EGA660 | LPEGCWWSNWGRECFMRQ |
| 2776 | EGA661 | LPSGCWWAIWGRECLLPP |
| 2777 | EGA662 | LADGCYWAIWGRECLLLP |
| 2778 | EGA663 | LPEGCFWTVWGKECLLLP |
| 2779 | EGA664 | LPEGCYWTTWGRECLLLP |
| 2780 | EGA665 | LPDGCWWSTWGRECVLLP |
| 2781 | EGA666 | MPDNCWWALWGKECFLMP |
| 2782 | EGA667 | LPEGCWWAVWGKECLLLP |
| 2783 | EGA668 | DPYGCWWTQWGRECHLLP |
| 2784 | EGA669 | LPEGCYWALWGKECLLPP |
| 2785 | EGA670 | GPEDCWWSTWGRECYLAP |
| 2786 | EGA671 | LPEGCIWTTWGKECFLQF |
| 2787 | EGA672 | LPAGCWWSAWGRECLLTP |
| 2788 | EGA674 | LNEQCWWAVWGHECLLLP |
| 2789 | EGA675 | IPDDCWWAVWGRECLLLN |
| 2790 | EGA676 | LPEGCWWSQWGRECILPP |
| 2791 | EGA677 | LPEGCFWTIWGQECFLLP |
| 2792 | EGA678 | LPDGCWWSQWGKECILLP |
| 2793 | EGA679 | LPEGCWWSTWGRECILLP |
| 2794 | EGA680 | LPDGCWWSIWGRECLLAP |
| 2795 | EGA681 | VPDGCWWSPWGRECLLPP |
| 2796 | EGA682 | VPESCWWAVWGRECLLLP |
| 2797 | EGA683 | LPDGCWWAMWGRECILEP |
| 2798 | EGA684 | LPEGCYWTIWGKECFLLP |
| 2799 | EGA685 | LPDNCVWMVWGRECLLVS |
| 2800 | EGA686 | LTEGCWWATWGRECFLLP |
| 2801 | EGA687 | LPKGCFWTVWGKDCYLLP |
| 2802 | EGA688 | LPEGCFWAKWGKECYLTQ |
| 2803 | EGA689 | LPDGCWWAVWGRECLMLP |
| 2804 | EGA693 | DSYGCFWTIWGRECLLLP |
| 2805 | EGA694 | LSDGCWWAVWGRECLIQK |
| 2806 | EGA695 | HPEGCWWAVWGKECLLPP |
| 2807 | EGA696 | LPEGCWWAIWGRECLMQP |
| 2808 | EGA697 | SLEGCWWSPWGKECFLPP |
| 2809 | EGA698 | LPSGCWWSTWGRECLLLP |
| 2810 | EGA699 | LPDGCYWAVWGRECLLLP |
| 2811 | EGA700 | LPEACWWATWGRECILLP |
| 2812 | EGA701 | LPEGCCWTVWGLECFLCP |
| 2813 | EGA702 | MPEGCYWAQWGKECLLVP |
| 2814 | EGA703 | LPEGCLWMVWGKECFLVP |
| 2815 | EGA704 | LPEGCHWAVWGKECQLQP |
| 2816 | EGA705 | LPEGCWWAPWGRECILPP |
| 2817 | EGA706 | LPEGCHWEIWGKECFLPP |
| 2818 | EGA707 | LPKGCYWATWGRECLLVP |
| 2819 | EGA708 | LPEGCYWAVWGKECLLRP |
| 2820 | EGA710 | IGDACYWTVWGRECLLLP |
| 2821 | EGA711 | LPDGCVWTVWGRECFGFP |
| 2822 | EGA712 | SPDGCYWALWGRECLLAP |
| 2823 | EGA713 | LPQGCWWSVWGKECILRP |
| 2824 | EGA714 | LPKGCWWAVWGKECLMQS |
| 2825 | EGA715 | LPEGCWWAVWGRECLMLH |
| 2826 | EGA716 | LPEGCYWTTWGKECFLLP |
| 2827 | EGA717 | YAEHCSMFPNDWICTLVT |

TABLE 17-continued

EGFR binding MRDs

| SEQ ID: | Ref. No. | Peptide Sequence |
|---|---|---|
| 2828 | EGA718 | YAEHCWQFPTDWICTLMP |
| 2829 | EGA719 | YVEHCWQFPTDWICTLKT |
| 2830 | EGA720 | YVDHCWHFPADWICGLST |
| 2831 | EGA721 | YEEIICRLFPADWICSLLQ |
| 2832 | EGA722 | YLEHCRHFPTDWICSLLP |
| 2833 | EGA723 | YLEHCRQFPGDWICTLLE |
| 2834 | EGA724 | YAEHCRMFPTDWICSLIT |
| 2835 | EGA725 | YVEHCCKFPTDWICTLNS |
| 2836 | EGA726 | YAEHCWLFPTDWICGLRA |
| 2837 | EGA727 | YAEHCRLFPTDWICTLLT |
| 2838 | EGA728 | YEEHCWLFPTDWICTLLT |
| 2839 | EGA731 | YAEHCWQFPTDWICSLSS |
| 2840 | EGA732 | YAAHCWQFPTDWICTLLP |
| 2841 | EGA733 | YAEHCSLFPSDWICSLMT |
| 2842 | EGA734 | YAEHCSQFPCDWICTLLT |
| 2843 | EGA735 | YAEHCCQFPSDWICTLMS |
| 2844 | EGA736 | YAEHCRLFPCDWICTLMT |
| 2845 | EGA737 | YAEHCWLFPTDWICTLLP |
| 2846 | EGA738 | YAEHCWMFPSDWICSLPT |
| 2847 | EGA739 | YADHCEMFPNDWICTLRT |
| 2848 | EGA740 | YAEHCRMFPSDWICTLIP |
| 2849 | EGA741 | YAEHCRLFPTDWICTLTT |
| 2850 | EGA742 | YAEHCSQFPTDWICTLIT |
| 2851 | EGA743 | YEEHCWLFPNDWICSLMT |
| 2852 | EGA744 | YAEHCQLFPSDWICSLET |
| 2853 | EGA746 | YAEHCAQFPTDWICSLIS |
| 2854 | EGA747 | YAQHCYQFPSDWICSLLP |
| 2855 | EGA748 | YAEHCRHFWTDWICSLKT |
| 2856 | EGA749 | YGEHCRSFPTDWICTLLP |
| 2857 | EGA750 | YSTHCRLFPTDWICTLEG |
| 2858 | EGA751 | YAEHCWHFPTDWICSLLP |
| 2859 | EGA752 | YFEHCRQFPTDWICTLMP |
| 2860 | EGA753 | YAEHCRLFPTDWICTIKS |
| 2861 | EGA755 | YVEIICWQFPSDWICTLLP |
| 2862 | EGA757 | YAEHCWRFPGDWICSLIT |
| 2863 | EGA758 | YAEHCRLFPTDWICSLRE |
| 2864 | EGA759 | YAEHCSMFPTDWICTLVT |
| 2865 | EGA760 | YLQHCLLFPTDWICTLLP |
| 2866 | EGA761 | YAEHCTLFPTDWICTLLP |
| 2867 | EGA762 | YAEHCWMFPTDWICSLRS |
| 2868 | EGA763 | YAEHCWLFPKDWICTLIT |
| 2869 | EGA764 | YEEHCWQFPGDWICSLRG |
| 2870 | EGA765 | YAEHCRIFPTDWICTLST |
| 2871 | EGA766 | YAEHCWQFPSDWICSLIE |
| 2872 | EGA767 | YAEHCSHFWTDWICTLST |
| 2873 | EGA768 | YAEHCRQFPSDWICTLLS |
| 2874 | EGA769 | YAAHCSLFPTDWICTLMP |
| 2875 | EGA770 | YAEHCWLFPKDWICTLDM |
| 2876 | EGA773 | YAEHCLQFPADWICTLRT |
| 2877 | EGA774 | YAGIICALFPSDWICSLLP |
| 2878 | EGA775 | YAEHCSYFPTDWICTLRT |
| 2879 | EGA776 | YLDHCRLFPTDWICSLLP |
| 2880 | EGA777 | YVEHCRLFPCDWICSLMI |
| 2881 | EGA779 | YAEHCFQFPHDWICSLMT |
| 2882 | EGA780 | YQEHCWRFPNDWICSLLP |
| 2883 | EGA781 | YAEHCRLFPGDWICTLST |
| 2884 | EGA782 | YAEHCSMFPSDWICSLMT |
| 2885 | EGA783 | YAEHCWHFPTDWICTLRS |
| 2886 | EGA784 | YAEHCGLFPGDWICTLKN |
| 2887 | EGA785 | YAEHCNMFPTDWICTLME |
| 2888 | EGA786 | YAEHCSFFPADWICTLIP |
| 2889 | EGA788 | YAEHCWMFPTDWICSLNR |
| 2890 | EGA789 | YPEHCWQFPGDWICTLLT |
| 2891 | EGA790 | YADHCRLFPTDWICTLVT |
| 2892 | EGA791 | YAEHCRLFPSDWICSLVT |
| 2893 | EGA792 | YAEHCRQFPADWICTLMT |
| 2894 | EGA793 | YSEHCWMFPSDWICTLME |
| 2895 | EGA795 | YAEHCSQFPTDWICTLLT |
| 2896 | EGA796 | LAEHCYLFPCDWICSLLT |
| 2897 | EGA798 | YAEHCWQFPADWICTLLP |
| 2898 | EGA799 | YREHCSLFPNDWICTLMP |
| 2899 | EGA801 | YAEHCSLFPTDWICSLMP |
| 2900 | EGA802 | YEEHCWLFPSDWICSLRQ |
| 2901 | EGA804 | LPEPCWWAPWGRECLLLP |
| 2902 | EGA805 | LPQGCWWAVWGKECHLLP |

TABLE 17-continued

EGFR binding MRDs

| SEQ ID: | Ref. No. | Peptide Sequence |
|---|---|---|
| 2903 | EGA806 | LYDTCYWTTWGKECLMPR |
| 2904 | EGA807 | LPDGCTWMVWGRECFLLP |
| 2905 | EGA808 | LPGGCWWAVWGRECQLLP |
| 2906 | EGA809 | HPDDCWWALWGRECLLLP |
| 2907 | EGA810 | KCNFNPWKAACG |
| 2908 | EGA811 | LPEGCWWALWGRECLLLP |
| 2909 | EGA812 | LLDACWWATWGKECIWRN |
| 2910 | EGA813 | LTYVCWWNMWGYECLPYE |
| 2911 | EGA814 | LPDGCWWAQWGRECLLKP |
| 2912 | EGA815 | LPAPCYWTTWGKECFIVP |
| 2913 | EGA816 | LIAPCYWTIWGKECFILD |
| 2914 | EGA817 | HPDNCWWAVWGRECLLLP |
| 2915 | EGA818 | LSDPCYWTTWGKECFLLR |
| 2916 | EGA819 | LTAPCYWTTWGKECLLLR |
| 2917 | EGA820 | LAEGCIWTTWGRECFLLP |
| 2918 | EGA821 | LPDGCYWTVWGRECFLPP |
| 2919 | EGA822 | LRDPCWWAVWGRECILLP |
| 2920 | EGA823 | QSPGCWWAVWGVECILLP |
| 2921 | EGA824 | IHEGCWWSSWGKECLLLP |
| 2922 | EGA825 | LPEGCWWATWGRECLLEP |
| 2923 | EGA826 | LPAGCYWANWGKECFLVP |
| 2924 | EGA828 | LTDPCYWTTWGKECLLHR |
| 2925 | EGA830 | LPEGCWWAPWGKECLLSP |
| 2926 | EGA831 | LPAPCYWTTWGKECLMPR |
| 2927 | EGA832 | LPDGCYWSMWGRECFLVP |
| 2928 | EGA833 | VPQGCYWATWGRECYLLP |
| 2929 | EGA834 | LPDSCWWSTWGRECILLP |
| 2930 | EGA835 | LPAPCYWTTWGKECLLQH |
| 2931 | EGA836 | LQEGCFWAVWGKECILLP |
| 2932 | EGA837 | LNEHCYWALWGKECFLPR |
| 2933 | EGA838 | LPEGCWWSPWGRECLLLP |
| 2934 | EGA840 | LPEGCFWTVWGKECLLMP |
| 2935 | EGA841 | LPDGCYWTTWGKECFMPR |
| 2936 | EGA842 | LPEGCWWSPWGKECLLMP |
| 2937 | EGA843 | LTPPCYWTIWGKECFMRQ |
| 2938 | EGA844 | LPEGCYWSVWGKECLLES |
| 2939 | EGA846 | LTDQCYWATWGRECILLR |
| 2940 | EGA847 | FPDGCYWAIWGRECLLQP |
| 2941 | EGA848 | LSGGCYWTTWGRECILLP |
| 2942 | EGA849 | LSSPCYWTTWGKECFIIR |
| 2943 | EGA850 | FPEGCWWALWGKECFLQP |
| 2944 | EGA851 | LPDGCWWSVWGRECLMLP |
| 2945 | EGA852 | LPEDCWWAIWGRECLLTP |
| 2946 | EGA853 | LPEPCYWTTWGKECFMIH |
| 2947 | EGA854 | LPQGCYWAVWGRECLLLP |
| 2948 | EGA855 | LPAGCWWSLWGKECYLLP |
| 2949 | EGA856 | LPEECWWAIWGRECHLLP |
| 2950 | EGA857 | LPAGCWWSVWGRECLLMP |
| 2951 | EGA858 | MPEGCFWAIWGRECFLLP |
| 2952 | EGA859 | LPDPCWWAPWGRECVLMP |
| 2953 | EGA860 | IPDGCYWAIWGRECFLLP |
| 2954 | EGA861 | LPAPCYWTTWGKECFLLR |
| 2955 | EGA862 | LTDSCYWTTWGRECFLIP |
| 2956 | EGA863 | IHDPCYWTVWGRECLLLP |
| 2957 | EGA864 | LPEGCWWSAWGRECILLQ |
| 2958 | EGA865 | LMGDCWWTVWGKECLLQP |
| 2959 | EGA868 | VPDSCWWSQWGRECLLPP |
| 2960 | EGA869 | LPEGCWWSVWGKECLMLP |
| 2961 | EGA870 | LATPCYWTTWGKECLIPR |
| 2962 | EGA871 | LLLGCSWHFWVYECLPPP |
| 2963 | EGA872 | INPPCYWTTWGKECFLHR |
| 2964 | EGA873 | LPEGCWWTQWGKECHLAP |
| 2965 | EGA874 | FPAGCYWAHWGRECLLLP |
| 2966 | EGA875 | LPEGCWWSIWGKECLLLP |
| 2967 | EGA876 | LPEGCYWAIWGKECHMTP |
| 2968 | EGA878 | IPEGCWWQPWALECFLLP |
| 2969 | EGA879 | IAEGCWWSIWGKECFLLP |
| 2970 | EGA880 | LPEPCYWTTWGKECHLPN |
| 2971 | EGA881 | LPPRCLWNPWGPECFLIH |
| 2972 | EGA882 | LTAPCWWTSWGRECYLFG |
| 2973 | EGA883 | RPDSCYWTTWGRECLWPR |
| 2974 | EGA884 | LPERCWWAIWGRECILLP |
| 2975 | EGA885 | ISQGCWWSKWGRECLLPP |
| 2976 | EGA886 | IPHGCWWAIWGRECLLLP |
| 2977 | EGA888 | YPEHCWWFPSDWICTLMT |

TABLE 17-continued

EGFR binding MRDs

| SEQ ID: | Ref. No. | Peptide Sequence |
|---|---|---|
| 2978 | EGA889 | YAEHCWRFPSDWICTLMT |
| 2979 | EGA890 | YADHCRLFPNDWICTLIT |
| 2980 | EGA891 | YAQHCYLFPMDWICTLTT |
| 2981 | EGA892 | YSEHCWQFPDDWICTLMT |
| 2982 | EGA893 | YAEHCRVFPTDWICTLRP |
| 2983 | EGA894 | YGQHCSLFPTDWICSLMT |
| 2984 | EGA895 | YAEHCRQFRTDWICTLMT |
| 2985 | EGA896 | YAEHCLTFPTDWICSLAQ |
| 2986 | EGA897 | YAGHCRDFPSDWICSLVP |
| 2987 | EGA898 | YAEHCWYFPTDWICTLT |
| 2988 | EGA899 | YQEHCWLFPTDWICSLTS |
| 2989 | EGA900 | YADHCCHFPADWICTLNA |
| 2990 | EGA901 | YAEHCWLFPTDWICSLMP |
| 2991 | EGA902 | YADHCLQFPLDWICTLMK |
| 2992 | EGA903 | YAEHCTQFPTDWICTLTS |
| 2993 | EGA904 | YAEHCRQFPSDWICTLMT |
| 2994 | EGA905 | YSEHCYLFPTDWICTLPT |
| 2995 | EGA906 | YVDHCWDFPTDWICTLLS |
| 2996 | EGA907 | YIEHCWQFPTDWICTLMT |
| 2997 | EGA908 | YADHCRFFPTDWICTLMP |
| 2998 | EGA909 | YAQHCMQFPTDWICTLMT |
| 2999 | EGA910 | YADIICWQFPSDWICTLLA |
| 3000 | EGA911 | YARHCMQFPTDWICSLTT |
| 3001 | EGA912 | YAEHCWQFPTDWICTLRS |
| 3002 | EGA913 | YEDHCSLFPKDWICGLMP |
| 3003 | EGA914 | YAEHCWQFPTDWICTLLP |
| 3004 | EGA915 | YEEHCQLFPTDWICTIRT |
| 3005 | EGA916 | YAEHCWLFPTDWICSLMT |
| 3006 | EGA918 | YAEHCWQFPTDWICTLMS |
| 3007 | EGA919 | YAEHCRQFPTDWICGLMT |
| 3008 | EGA920 | YADHCSQFPTDWICTLIP |
| 3009 | EGA921 | YSEHCWLFPTDWICTLVP |
| 3010 | EGA922 | YAAHCWQFPTDWICTLIP |
| 3011 | EGA924 | YAEHCWLFPSDWICTLMP |
| 3012 | EGA925 | YAEHCYMFPTDWICTLTA |
| 3013 | EGA927 | YTEHCWLFPTDWICSLMP |
| 3014 | EGA929 | YEQHCWHFPNDWICTLMT |
| 3015 | EGA930 | YAEIICWLFPTDWICTLMT |
| 3016 | EGA931 | YYEHCTLFPSDWICTLMT |
| 3017 | EGA932 | YEEHCALFPTDWICTLH |
| 3018 | EGA933 | YGEHCWQFPTDWICTLVT |
| 3019 | EGA934 | YSEHCWLFPSDWICSLDT |
| 3020 | EGA935 | YDEHCRQFPTDWICKLTT |
| 3021 | EGA936 | YAEHCYRFPTDWICTLMS |
| 3022 | EGA937 | YAGHCSRFPTDWICTLMA |
| 3023 | EGA938 | YAQHCWQFPADWICTLIE |
| 3024 | EGA939 | YDEHCLKFPADWICSLPR |
| 3025 | EGA940 | YAGHCNLFPTDWICTLKT |
| 3026 | EGA941 | YEEHCGLFPTDWICTLMD |
| 3027 | EGA942 | YSEHCWLFPTDWICTLPT |
| 3028 | EGA944 | YAEHCWMFPTDWICSLLP |
| 3029 | EGA945 | YAEHCWQFPSDWICTLLP |
| 3030 | EGA946 | YAEHCWRFPTDWICTLMT |
| 3031 | EGA947 | YTSHCRHFPNDWICTLLP |
| 3032 | EGA948 | YAEHCWQFPHDWICTLTK |
| 3033 | EGA949 | YADHCWLFPNDWICTLIK |
| 3034 | EGA950 | YAEHCWLFPTDWICTLRT |
| 3035 | EGA951 | FQGHCALFPTDWICTLKS |
| 3036 | EGA952 | YAEHCRLFPADWICSLMT |
| 3037 | EGA953 | YAEHCGLFPTDWICTLMT |
| 3038 | EGA954 | YREHCGQFPNDWICSLLT |
| 3039 | EGA955 | YVEHCYQFPADWICTLKT |
| 3040 | EGA956 | YAEHCRHFPSDWICTLTK |
| 3041 | EGA957 | YAEHCSQFPTDWICSLLT |
| 3042 | EGA959 | YAVHCWQFPADWICSLEM |
| 3043 | EGA960 | YEEHCLQFPADWICTLLP |
| 3044 | EGA961 | YAEHCGMFPNDWICSLTK |
| 3045 | EGA962 | YADIICAIIFPTDWICTLMT |
| 3046 | EGA963 | YPEHCWLFPTDWICTLVA |
| 3047 | EGA964 | YAEHCWQFPADWICSLPS |
| 3048 | EGA965 | YAEHCWQFPTDWICSLLD |
| 3049 | EGA966 | YAQHCWMFPADWICTLMT |
| 3050 | EGA967 | YLAHCWHFPNDWICSLLP |
| 3051 | EGA968 | YTKHCQRLPTYKICNLFM |
| 3052 | EGA969 | YSEHCWLFPTDWICHLMP |

TABLE 17-continued

EGFR binding MRDs

| SEQ ID: | Ref. No. | Peptide Sequence |
|---|---|---|
| 3053 | EGA970 | YAEHCYNFPSDWICSLLT |
| 3054 | EGA971 | YAEHCWQFPTDWICSLMT |
| 3055 | EGA972 | YEEHCWQFPADWICTLLT |
| 3056 | EGA973 | YAEHCWHFPSDWICTLKE |
| 3057 | EGA974 | YAMHCSQFPSDWICTLMT |
| 3058 | EGA975 | YAEHCRQFPTDWICSLMT |
| 3059 | EGA976 | YEEHCWLFPSDWICTLMP |
| 3060 | EGA977 | YAEHCWLFPTDWICNLIP |
| 3061 | EGA978 | YEKIICYQFPSDWICSLKT |
| 3062 | EGA979 | LPDGCCWLQWGMECHLCP |
| 3063 | EGA980 | IPDDCYWTVWGRECLLVP |
| 3064 | EGA981 | LTDGCYWTIWGRECLLLP |
| 3065 | EGA982 | LPDGCWWSTWGRECLLVP |
| 3066 | EGA984 | LPEGCWAIWGKECLLPL |
| 3067 | EGA985 | DPYGCYWAAWGRECLLLP |
| 3068 | EGA986 | LPEGCWWSVWGRECLLPS |
| 3069 | EGA987 | LPEDCWWATWGRECLLQP |
| 3070 | EGA988 | LPEGCHWAIWGRECLLPP |
| 3071 | EGA989 | LPEGCWWANWGRECLLLP |
| 3072 | EGA991 | IPEGCWWAQWGRECILAA |
| 3073 | EGA992 | ISDGCFWAVWGRECLLAA |
| 3074 | EGA993 | GTDGCWWEVWGRECLLTP |
| 3075 | EGA994 | LPEGCWWSPWGRECLLPP |
| 3076 | EGA995 | LTEPCYWTTWGKECHMPR |
| 3077 | EGA996 | DEAGCWWEIWGRECILSP |
| 3078 | EGA997 | IHDHCCWTIWGYECQLCP |
| 3079 | EGA998 | LHDGCWWEVWGRECFVPS |
| 3080 | EGA999 | FPDVCYWTVWGRECLLLP |
| 3081 | EGA1001 | HPDGCYWTVWGRECLLPP |
| 3082 | EGA1002 | YSEVCWWEVWGRECFLRS |
| 3083 | EGA1003 | LPEDCWWAQWGRECFLPA |
| 3084 | EGA1004 | LNDPCYWTTWGKECLLPR |
| 3085 | EGA1005 | YEEHCGQFPTDWICTLIS |
| 3086 | EGA1006 | YEEHCWLFPSDWICTLMT |
| 3087 | EGA1007 | YEEHCWLFPTDWICTLVT |
| 3088 | EGA1008 | YAEHCWLFPSDWICTLLT |
| 3089 | EGA1009 | YAEHCCRFPSDWICTLMSGQAAAGGSQAQICRLLPSDRVCTLMP |
| 3090 | EGA1010 | PESWCHTLYWNLQHCLSQE |
| 3091 | EGA1011 | LPEGCYWATWGKECLLQP |

TABLE 18

ErbB2 binding MRDs

| SEQ ID: | Ref. No. | Peptide Sequence |
|---|---|---|
| 3113 | EGB98 | LCFAHQQAMFCN |
| 3114 | EGB104 | TCHPSWGGKTCT |
| 3115 | EGB106 | ICVAMTVTCS |
| 3116 | EGB117 | FCIHFPHSWVCH |
| 3117 | EGB122 | WCHLFPYSQWCH |
| 3118 | EGB123 | ICKYFPFSHFCW |
| 3119 | EGB125 | WDHWHIWHFG |
| 3120 | EGB127 | LCETQPVSFSCSGQACPGGGGGSLCQFWPHIDFCV |
| 3121 | EGB128 | WCHFQIWHHPCY |
| 3122 | EGB129 | FCQFFPWTMVCQ |
| 3123 | EGB130 | MPWEYLHQHQ |
| 3124 | EGB131 | HCNWAPWWGYCMGQAGQGRCTAGGGSIICYWPPPNTRCW |
| 3125 | EGB132 | PCVFVIEGCF |
| 3126 | EGB133 | ICSRWPYWPHCWGQARQAAGGGSNCSHEPGSVVCL |
| 3127 | EGB134 | WCRYYSVVCS |
| 3128 | EGB137 | ICWIGTFGCA |
| 3129 | EGB221 | PPYRCIPSESWICSFILGQA |
| 3130 | EGB222 | QGGGCRGPHWYQMFYCVSPS |
| 3131 | EGB224 | LVSFCPWGPDWYCSHYH |
| 3132 | EGB225 | PPRWWCEHYGVQDLMCPGLF |
| 3133 | EGB227 | SVFDCKYAPMWYCKHYL |
| 3134 | EGB249 | GSLGCVLPMVFCRSYQ |
| 3135 | EGB263 | YGKVLCSKWQCCKLLR |
| 3136 | EGB264 | FCHLCQMFPAWCFLQT |
| 3137 | EGB289 | RWVHCKQHGHYFSQRCIETW |
| 3138 | EGB310 | PRRWCHMDFHHSPMCHWHL |
| 3139 | EGB315 | HTRKCHKFMFQHKHCIEVL |
| 3140 | EGB334 | MVVPCFTSQRQMAPACIAPRGQAGQGGPGCGRWLPRQRCFIKHGHMSESCMVSA |

TABLE 18-continued

ErbB2 binding MRDs

| SEQ ID: | Ref. No. | Peptide Sequence |
|---|---|---|
| 3141 | EGB335 | YGKKCDKHDHSKPGVCIKKY |
| 3142 | EGB339 | LLFDCWRIPEWHACGKDY |
| 3143 | EGB344 | WNRICMYQWANHFTVCAPGP |
| 3144 | EGB350 | ERALCHKPWSHIMPWCPQKL |
| 3145 | EGB354 | WKPWCKLYWRADPACLQIK |
| 3146 | EGB356 | WSGWCMYTWGWAPCRSVD |
| 3147 | EGB358 | WSGWCVKQNAWYFCTGKI |
| 3148 | EGB364 | VAQSSAFCEEFPVHWYCSFYVG |
| 3149 | EGB366 | VAQSTPSCGMPKWYCTHYFG |
| 3150 | EGB367 | VAQSSEHCYFGWNSYHCWSQAG |
| 3151 | EGB373 | VAQREKHCVPEWYCKHYM |
| 3152 | EGB375 | WSGWCWSDESKYWYSCHSRA |
| 3153 | EGB380 | WSGLCLWDMFWQQCHGSS |
| 3154 | EGB383 | SVLGCDDVGFYQCLEFLGQA |
| 3155 | EGB384 | WSGWCQFKDGQWAKCTGRV |
| 3156 | EGB385 | WSGYCFDSTHEGWYQCGAVS |
| 3157 | EGB386 | WSGWCFHETHWQHCSAGG |
| 3158 | EGB387 | WTGWCLVENQWTYCQNGD |
| 3159 | EGB388 | WSGWCFEEAGWGHCMGLP |
| 3160 | EGB389 | WSGYCFDRGYWQQCSSAW |
| 3161 | EGB391 | WSGYCYVFDHWESCRGRE |
| 3162 | EGB392 | WSGWCFKEAGWGHCMGLP |
| 3163 | EGB393 | WSGCCHWEAAWNNCGGWT |
| 3164 | EGB394 | WSGWCMISNQWRHCGSPD |
| 3165 | EGB395 | WTGWCEGHGQWGWCHSSL |
| 3166 | EGB396 | WVVSCHTSTQVLMCVCLL |
| 3167 | EGB398 | WSGYCNSNGAWMMCGGGT |
| 3168 | EGB399 | WSGWCFEQAGWGHCLGLP |
| 3169 | EGB400 | WSGWCQSIIGEWMRCRSWT |
| 3170 | EGB401 | WSGWCEEQFGWSQCRRSP |
| 3171 | EGB403 | WSGWCFQETHWQHCMGLR |
| 3172 | EGB404 | WTGFCFDENHWYICGTGR |
| 3173 | EGB406 | WRGWCQIAGEWQHCSNYS |
| 3174 | EGB407 | WTGYCVDQERHQWHCFGRS |
| 3175 | EGB408 | WQGYCYQEVYALWDHCSGPL |
| 3176 | EGB409 | WSGWCFAMEHQKWKQCAGSS |
| 3177 | EGB410 | GSMLCLWFNDNPQCFEVC |
| 3178 | EGB411 | WSGWCETPHQWHDCKGTI |
| 3179 | EGB412 | MIEFCWYYMALPECWIPT |
| 3180 | EGB413 | IIEFCWYLQQYDECWVPK |
| 3181 | EGB414 | WSGYCYEGVTWRSCWGDM |
| 3182 | EGB416 | WSGWCFQFDNWDHCTGSV |
| 3183 | EGB419 | SFTLTCGAHQCLCHVL |
| 3184 | EGB420 | WSGWCQHMQVPIWHACSGGL |
| 3185 | EGB421 | WSGLCLTEEVWHVCQGTI |
| 3186 | EGB423 | WTGFCQSSKTQKWQHCRGGG |
| 3187 | EGB425 | WSGWCEEELQWSFCSGHL |
| 3188 | EGB426 | WSGYCVDFEFPAWGYCHGNI |
| 3189 | EGB427 | WSGWCYSQALMSWTYCHEFK |
| 3190 | EGB428 | WSGWCFYQVEYIWRSCEPAS |
| 3191 | EGB429 | NRSGCIEIHYEDCLLIV |
| 3192 | EGB430 | WTGWCYMEHFWDICHGPA |
| 3193 | EGB431 | WTGYCLSSERHKWHHCFGRS |
| 3194 | EGB432 | WSGWCFQFDNWDRCPGSV |
| 3195 | EGB433 | WSGYCQMKDHWAHCGHSE |
| 3196 | EGB435 | WSGWCLFADGWGHCYGVI |
| 3197 | EGB436 | WSGWCFIKTHWGHCYGQI |
| 3198 | EGB437 | WSGWCFYVDHWDYCGGLI |
| 3199 | EGB438 | WSGYCEGTDHWYHCGGSM |
| 3200 | EGB439 | WSGWCFYGDRWGHCSGLP |
| 3201 | EGB440 | WSGWCFYGSYWGHCKGIL |
| 3202 | EGB441 | WSGYCEFEDHWDYCGTPK |
| 3203 | EGB442 | WSGWCLMETGWGHCKGLP |
| 3204 | EGB444 | WSGWCFSADGWGIICRGVI |
| 3205 | EGB445 | WSGYCDMGDHWSHCGHSG |
| 3206 | EGB446 | WSGWCFYGSWWDYCSGGH |
| 3207 | EGB447 | WSGYCEFEDHWDFCGTSR |
| 3208 | EGB448 | WSGYCEYQDRWAHCGGTPGQAGQGGGSWSGYCRTEGHWAHCGGSV |
| 3209 | EGB450 | WSGWCLGEAGWGHCRGLL |
| 3210 | EGB451 | WSGWCLYESGWGHCYGWI |
| 3211 | EGB452 | WSGYCEYKYKWDHCGTSV |
| 3212 | EGB453 | WSGYCEFKDHWAHCGGSL |
| 3213 | EGB455 | WSGWCLGETGWGHCSGMP |
| 3214 | EGB456 | WSGYCEFKDHWAHCGGSV |

TABLE 18-continued

ErbB2 binding MRDs

| SEQ ID: | Ref. No. | Peptide Sequence |
|---|---|---|
| 3215 | EGB458 | WSGYCEFQDHWGYCGNTE |
| 3216 | EGB459 | WSGYCEFKDYWAHCSGSM |
| 3217 | EGB460 | WSGYCEYSDHWAHCGGSL |
| 3218 | EGB462 | WSGWCLYDAGWGYCSGLQ |
| 3219 | EGB463 | WSGYCEMQDIIWDYCSGSI |
| 3220 | EGB464 | WSGWCFTEGVWGHCKGLG |
| 3221 | EGB465 | WSGYCEFKDHWDFCGHSA |
| 3222 | EGB469 | WSGWCFLDSGWGHCQGLI |
| 3223 | EGB470 | WSGWCFNSNGWYQCGGLI |
| 3224 | EGB471 | WSGWCFFGASWGHCSGFP |
| 3225 | EGB472 | WSGWCFFGAGWDYCHGQP |
| 3226 | EGB473 | WSGYCEFKDHWDYCGGSE |
| 3227 | EGB474 | WSGWCFYGTGWGYCYGLI |
| 3228 | EGB476 | WSGYCEYKHHWAHCGTRH |
| 3229 | EGB477 | WSGYCLMKDHWAHCGHSE |
| 3230 | EGB478 | WSGWCMGMSGWDHCRGLI |
| 3231 | EGB479 | WSGYCEINGKWDYCSHSH |
| 3232 | EGB480 | WSGWCFFGAGWGHCFGNP |
| 3233 | EGB481 | WSGWCLQGAGWGHCSGRI |
| 3234 | EGB482 | WSGWCFNGVGWGHCFGLI |
| 3235 | EGB483 | WSGWCFYEAFWGIICTGPT |
| 3236 | EGB484 | WSGWCFDGDGWGYCTGVS |
| 3237 | EGB485 | WSGWCLRSNGWDYCHGPT |
| 3238 | EGB486 | WSGWCLSGAGWGYCSGLP |
| 3239 | EGB487 | WSGWCFFGSAWGHCGFP |
| 3240 | EGB488 | WSGWCFYSTIIWAQCKGGII |
| 3241 | EGB489 | WSGWCETDRGWSFCSSPL |
| 3242 | EGB490 | WSGWCESELQWGFCSGLL |
| 3243 | EGB491 | WSGWCEGETQWYFCSGHL |
| 3244 | EGB492 | WSGWCEYELQWSFCSGQL |
| 3245 | EGB493 | WSGWCEGEREWPFCSGHI |
| 3246 | EGB494 | WSGWCEYEHHWDFCSGHL |
| 3247 | EGB495 | LPPPCYWTTWGKECQMFD |
| 3248 | EGB496 | WSGWCFSSSGWGFCGGLN |
| 3249 | EGB497 | WSGWCFSPAGWGIICYGLS |
| 3250 | EGB498 | WSGWCLDRAGWGHCHGLI |
| 3251 | EGB499 | WSGWCLTKSGWGHCLGPT |
| 3252 | EGB500 | WSGWCLYEFGWGYCSGLI |
| 3253 | EGB501 | WSGWCEYELHWSYCWGPL |
| 3254 | EGB502 | WSGWCEGELYWSYCSGYL |
| 3255 | EGB503 | WSGWCEYELSWSFCSGSL |
| 3256 | EGB504 | WSGWCEYEGFWSFCSGNL |
| 3257 | EGB505 | WSGWCEGVLQWYFCSGHI |
| 3258 | EGB506 | WSGWCEYDLHWSFCSGHL |
| 3259 | EGB507 | WSGWCLGKAGWGHCGGLI |
| 3260 | EGB508 | WSGWCFFGSIIWGIICFGSP |
| 3261 | EGB509 | WSGWCLLDAEWGHCSGLI |
| 3262 | EGB510 | WSGWCLSNDGWGHCWGLM |
| 3263 | EGB511 | WSGWCLSGTGWGHCYGLH |
| 3264 | EGB513 | WSGWCLVGTQWSFCSGLI |
| 3265 | EGB514 | WSGWCEKEFLWTFCSGTI |
| 3266 | EGB515 | WSGWCESDTHWSFCSGQL |
| 3267 | EGB516 | WSGWCEGVSEWSFCSGLI |
| 3268 | EGB518 | WSGWCLGLDGWDHCYGRP |
| 3269 | EGB519 | WSGWCFFGDRWGHCHGQP |
| 3270 | EGB520 | WSGWCFVGASWGHCYGMI |
| 3271 | EGB521 | WSGWCLSDAGWGACGGAS |
| 3272 | EGB522 | WSGWCLEWNGWGHCSGIP |
| 3273 | EGB523 | WSGWCEGELQWFFCSGTI |
| 3274 | EGB524 | WSGWCEGEHHWYFCRGNF |
| 3275 | EGB526 | WSGYCEGEQQWFCSGQV |
| 3276 | EGB527 | WSGWCENKVGWSFCSGHI |
| 3277 | EGB528 | WSGWCEGERTWHFCSGPL |
| 3278 | EGB530 | WSGWCCFGTSWGYCHGPP |
| 3279 | EGB531 | WSGWCLLDAGWGHCKGML |
| 3280 | EGB532 | WSGWCFYGHGWGHCHGTP |
| 3281 | EGB533 | WSGWCFDYTRWGIICSGMP |
| 3282 | EGB534 | WSGWCLFSAGWGHCSGLI |
| 3283 | EGB535 | WSGWCEGELQWSFCWGHI |
| 3284 | EGB537 | WSGWCEEEHQWSFCSGYI |
| 3285 | EGB538 | WSGWCEGEREWYFCSGFF |
| 3286 | EGB539 | WSGWCEGKLKWNYCSGYL |
| 3287 | EGB540 | WSGWCEQDQKWNYCSGYI |
| 3288 | EGB542 | WSGWCFYEVRWGHCHGSI |
| 3289 | EGB543 | WSGYCLSESGWGHCGGLL |

TABLE 18-continued

ErbB2 binding MRDs

| SEQ ID: | Ref. No. | Peptide Sequence |
|---|---|---|
| 3290 | EGB544 | WSGWCLSYSGWGHCSGSP |
| 3291 | EGB545 | WSGWCFYGDYWGHCSGQP |
| 3292 | EGB546 | WSGWCFKITGWGHCSGLI |
| 3293 | EGB547 | WSGWCENELQWSFCSGHI |
| 3294 | EGB548 | WSGWCEGERQWSFCSGSI |
| 3295 | EGB549 | WSGWCEYEFKWSFCSGIII |
| 3296 | EGB550 | WSGWCEHEMYWSYCSGHK |
| 3297 | EGB551 | WSGWCEGELRWFFCSGTL |
| 3298 | EGB553 | WSGWCFYGTHWGHCGGLP |
| 3299 | EGB554 | WSGWCFDGGRWGYCSGPL |
| 3300 | EGB555 | WSGWCLKGDGWGHCWGLI |
| 3301 | EGB556 | WSGWCLRVSGWDHCSGHP |
| 3302 | EGB557 | TDSWCHTLYWALQHCVAQE |
| 3303 | EGB558 | WSGWCLMGDSWGHCSGLI |
| 3304 | EGB559 | WSGWCEGEVGWFFCSGYL |
| 3305 | EGB560 | WSGWCEYELQWSFCFGPS |
| 3306 | EGB561 | PDSSCIITLYWQLIIIICARRE |
| 3307 | EGB562 | WSGWCEGDLQWYYCSGHI |
| 3308 | EGB563 | WSGWCEEALRWSYCSGHI |
| 3309 | EGB565 | WSGWCLGDAGWGHCGGLP |
| 3310 | EGB566 | WSGWCFFDTHWGHCSGLL |
| 3311 | EGB567 | WSGWCFNHGAWGHCRGLI |
| 3312 | EGB568 | WSGWCYEHTGWRHCGLI |
| 3313 | EGB569 | WSGWCLTREGWGHCKGLI |
| 3314 | EGB570 | WSGWCLSGVGWFHCKGMI |
| 3315 | EGB571 | WSGWCEGESQWFFCSGLI |
| 3316 | EGB572 | WSGWCEYESHWSFCSGHI |
| 3317 | EGB573 | WSGWCEGERKWSYCSGQI |
| 3318 | EGB574 | WSGWCEGELHWYSCSGHM |
| 3319 | EGB575 | PDSWCHTLYWDLLYCVNQE |
| 3320 | EGB577 | WSGWCETPCGWESCHGTI |
| 3321 | EGB579 | WSGWCESTDSWHFCRGNI |
| 3322 | EGB580 | WSGWCETPSGWKACRGNI |
| 3323 | EGB581 | WSGWCETGVGWHECHGTI |
| 3324 | EGB582 | WSGWCEAERQWTFCSGHI |
| 3325 | EGB583 | WSGWCENSEGWDFCNGTI |
| 3326 | EGB584 | WSGWCETQKGWHSCHGSI |
| 3327 | EGB585 | WSGWCLTGTDWIIFCRGFI |
| 3328 | EGB586 | WSGWCETYKGWHACHGKI |
| 3329 | EGB587 | WSGWCETNAGWIQCYGSI |
| 3330 | EGB588 | WSGWCQTGANWHYCNGTI |
| 3331 | EGB589 | WSGWCLADGMWGHCNGTT |
| 3332 | EGB590 | WSGWCEGRDAWYQCKGTI |
| 3333 | EGB591 | WSGYCLTDGTWHHCKGTI |
| 3334 | EGB592 | WSGWCKTGKKWHHCGGTI |
| 3335 | EGB593 | WSGWCETSSGWHQCSGII |
| 3336 | EGB595 | WSGWCEEKGQWVSCGGSL |
| 3337 | EGB596 | WSGWCEGELQWYFCSGHL |
| 3338 | EGB597 | WSGWCEGEHKWSFCSGHL |
| 3339 | EGB598 | WSGWCESDKGWYQCRGTI |
| 3340 | EGB599 | YEEHCRLFPADWTCSLLQ |
| 3341 | EGB600 | WSGWCETPGIIWYQCRGSI |
| 3342 | EGB601 | ADSWCHTLYWNLRHCEIQE |
| 3343 | EGB602 | WSGWCNSGGGWHQCRGTI |
| 3344 | EGB603 | WSGWCLTDNKWHSCIGTI |
| 3345 | EGB604 | WSGWCETDRGWHDCHGTI |
| 3346 | EGB605 | WSGWCETKDHWHACNGII |
| 3347 | EGB606 | WSGWCEGELQWYFCSGKI |
| 3348 | EGB607 | PESWCHTLYWNLQHCLSQE |
| 3349 | EGB609 | WSGWCETSGGWHYCKGTI |
| 3350 | EGB610 | WSGWCETDQGWHHCWGTI |
| 3351 | EGB611 | WSGWCETKFGWNYCKGSI |
| 3352 | EGB612 | WSGWCFATSGWIISCRGTA |
| 3353 | EGB613 | WSGWCETGNGWDRCWGNI |
| 3354 | EGB614 | WSGWCEGQLQWFFCSGQI |
| 3355 | EGB615 | WSGWCERSWGWEQCRGTI |
| 3356 | EGB616 | WSGWCEYEEKWAFCSGYI |
| 3357 | EGB617 | WSGYCEGELQWYFCTGHL |
| 3358 | EGB618 | WSGWCETSVGWHKCSGTI |
| 3359 | EGB619 | WSGWCRIETGWDFCSGTI |
| 3360 | EGB620 | WSGWCETSKGWHFCSGTI |
| 3361 | EGB621 | WSGWCESSHGWHGCKGII |
| 3362 | EGB622 | WSGWCEYNGYWDYCTGTI |
| 3363 | EGB623 | WSGWCETGKYWHYCSGTI |
| 3364 | EGB624 | WSGWCEGKHQWYFCSGNL |

TABLE 18-continued

ErbB2 binding MRDs

| SEQ ID: | Ref. No. | Peptide Sequence |
|---|---|---|
| 3365 | EGB625 | WSGWCETELGWHQCRGTI |
| 3366 | EGB626 | WSGWCEGQTKWYFCSGQI |
| 3367 | EGB627 | WSGWCLFDSKWDYCQGNI |
| 3368 | EGB628 | ANSWCHTLYWDLMYCVWQE |
| 3369 | EGB629 | WSGWCQTGMRWHQCYGTI |
| 3370 | EGB630 | WSGWCESNGTWHGCKGTI |
| 3371 | EGB631 | WSGWCEGKHGWYSCRGTI |
| 3372 | EGB632 | WSGWCETLSGWHQCHGVI |
| 3373 | EGB633 | WSGWCEGKEKWIIIICNGSI |
| 3374 | EGB634 | WSGWCETSEGWHSCYGSI |
| 3375 | EGB635 | WSGWCLNELGWQQCFGTI |
| 3376 | EGB636 | WSGWCERVSGWNYCHGTI |
| 3377 | EGB638 | WSGWCYAPTGWHHCVGTT |
| 3378 | EGB639 | WSGWCETGTGWYHCGGTI |
| 3379 | EGB640 | PDSWCHTLYWHLQHCLSQE |
| 3380 | EGB641 | WSGWCEYELRWDFCSGHI |
| 3381 | EGB642 | WSGWCETVNGWHQCTGTI |
| 3382 | EGB643 | WSGWCLTKNSWDFCSGTI |
| 3383 | EGB644 | WSGWCLTNGVWHGCRGII |
| 3384 | EGB645 | WSGFCLTEESWHHCTGPI |
| 3385 | EGB646 | WSGWCEAIDMWYQCHGPI |
| 3386 | EGB647 | WSGWCFTGDLWHACTGII |
| 3387 | EGB648 | WSGWCEGELQWYYCSGKI |
| 3388 | EGB649 | WSGWCEGEFQWYFCSGQF |
| 3389 | EGB650 | WSGWCETNGKWDFCQGTI |
| 3390 | EGB651 | WSGWCETPVGWEQCTGTI |
| 3391 | EGB652 | WSGWCEGKLHWYFCSGHM |
| 3392 | EGB653 | WSGWCEGALGWSSCSGHG |
| 3393 | EGB654 | YEEHCALFPTDWICTLH |
| 3394 | EGB655 | WSGWCEGIGAWHFCKGII |
| 3395 | EGB656 | WSGWCESNDGWYQCKGDI |
| 3396 | EGB657 | WSGWCETLNGWYGCHGTM |
| 3397 | EGB658 | WSGWCENNDGWHHCGSI |
| 3398 | EGB659 | WSGYCETGRGWIIMCQGTI |
| 3399 | EGB660 | WSGWCETVTGWDYCNGKI |
| 3400 | EGB661 | WSGWCETDEGWRQCSGTI |
| 3401 | EGB662 | WSGWCMTLDKWHQCYGTI |
| 3402 | EGB663 | WSGWCETNNGWYACWGMI |
| 3403 | EGB664 | WSGWCFNEAGWGHCYGLP |
| 3404 | EGB665 | WSGWCETDRGWHECHGTI |
| 3405 | EGB666 | WSGWCETKFGWSYCKGTI |
| 3406 | EGB668 | WSGWCEGEDGWHSCRGTI |
| 3407 | EGB669 | WSGWCETSKGWHFCSGII |
| 3408 | EGB670 | PKYSCVYSIMKEKWHCRAQT |
| 3409 | EGB673 | FKPHCVYKHQTWVCGPPA |
| 3410 | EGB675 | THMHCYQHKHHYHCRTSL |
| 3411 | EGB686 | GPELCHHMAGHEWCLRYY |
| 3412 | EGB692 | HRSKCFMMYWDENCLQPW |
| 3413 | EGB693 | LGGRCMLFALKQCSMGH |
| 3414 | EGB696 | WSRLCTMRLPSTCGVWE |
| 3415 | EGB697 | RSWHCSHQMGSKPHCVLSP |
| 3416 | EGB698 | TWFRCTPHKHHYHCKHNV |
| 3417 | EGB705 | GIWICRHDSPYMKPHCIFTS |
| 3418 | EGB707 | TWSKCFMVPLGDYCTRAL |
| 3419 | EGB708 | SVWKCVKIIPFKIKPLCKLES |
| 3420 | EGB710 | RTWFCEKMHGQKFHCVSWF |
| 3421 | EGB712 | ADSWCHTLFWQLQHCVWQE |
| 3422 | EGB714 | KWRCCYGQFQPACNAVS |
| 3423 | EGB716 | PRYKCVFNWEVQKWQCSVWS |
| 3424 | EGB722 | PNRYCYTYPHSVKCAWMY |
| 3425 | EGB723 | DPSRCSKAYQMLYQCRTLI |
| 3426 | EGB729 | STDLCWPHKKHWHCPPAN |
| 3427 | EGB730 | SAWYCTKHMPQSKYHCISMR |
| 3428 | EGB732 | KWWKCGVIFEICQIVP |
| 3429 | EGB738 | AQLKCFEKLYMCRHHL |
| 3430 | EGB739 | VDRVCQFFMQKCWSSP |
| 3431 | EGB740 | KWTRCIPRMETHTCDCLL |
| 3432 | EGB746 | KLPQCLWEWDNRDCRWLL |
| 3433 | EGB748 | LIIRFCDIIFAIQCRFCN |
| 3434 | EGB758 | LICKQHKNHWHCRNYY |
| 3435 | EGB763 | KPWKCFYSYKIQHWKCHGVS |
| 3436 | EGB770 | TDSWCHTLYWQLHHCAILE |
| 3437 | EGB771 | KWRCCYGQFQQACNAVS |
| 3438 | EGB778 | WTHACVVWNMKQMEACTSLT |
| 3439 | EGB779 | LLNQCLQWAFHNCGCWN |

TABLE 18-continued

ErbB2 binding MRDs

| SEQ ID: | Ref. No. | Peptide Sequence |
|---|---|---|
| 3440 | EGB780 | WSGYCELKDRWAYCSGSI |
| 3441 | EGB781 | HRAPCFSCTACRQPCFSLT |
| 3442 | EGB785 | WSGYCEMKGYWAHCTGLI |
| 3443 | EGB786 | WSGYCEFLDHWDHCSGGE |
| 3444 | EGB787 | WSGYCEYKDIIWDIICGSSV |
| 3445 | EGB788 | WSGYCEYKDHWDYCGSSV |
| 3446 | EGB789 | WSGYCEYKDHWDFCGNVD |
| 3447 | EGB791 | WSGYCEYRDHWAHCGGSL |
| 3448 | EGB792 | WSGYCEFEGYWAHCGGSI |
| 3449 | EGB795 | WSGYCEYIDHWGYCQGSI |
| 3450 | EGB796 | WSGYCEMNDHWDYCYGSI |
| 3451 | EGB798 | WSGYCEYKDHWGYCGGSI |
| 3452 | EGB799 | WSGYCQLMDHWDYCHGQG |
| 3453 | EGB802 | WSGYCEMTDHWAHCSGSH |
| 3454 | EGB803 | WSGYCEFEDHWDYCHGSV |
| 3455 | EGB805 | WSGYCEMKDHWAHCGGLI |
| 3456 | EGB806 | WSGYCEFKDHWDYCHGSV |
| 3457 | EGB807 | WSGYCEMGDHWDYCSGSV |
| 3458 | EGB808 | WSGYCEFNGFWAHCGGFI |
| 3459 | EGB809 | WSGYCLMKDHWGYCGGWI |
| 3460 | EGB810 | WSGYCEFEDHWDYCGNSE |
| 3461 | EGB811 | FQGHCALFPTDWICTLKS |
| 3462 | EGB813 | WSGYCEFKTHWGHCGNPQ |
| 3463 | EGB814 | WSGYCEFKDHWDHCHSSG |
| 3464 | EGB816 | WSGYCEKEGYWAHCRGTI |
| 3465 | EGB817 | WSGYCEMKGIIWAIICGGSP |
| 3466 | EGB818 | WSGYCNMGDHWDHCSGSI |
| 3467 | EGB820 | WSGYCEFKDHWAHCSGSL |
| 3468 | EGB822 | WSGYCEMKGYWDFCGGLI |
| 3469 | EGB823 | WSGYCEFQDYWDYCGGSI |
| 3470 | EGB824 | WSGYCEMEHGWDYCSGTI |
| 3471 | EGB825 | WSGYCEFKDHWDHCGDSE |
| 3472 | EGB826 | WSGYCELEDHWAFCGGTI |
| 3473 | EGB827 | WSGYCEFKGYWDFCYGSM |
| 3474 | EGB829 | WSGYCEGQYFWYHCSGSG |
| 3475 | EGB830 | WSGYCEFQDHWDHCFGSS |
| 3476 | EGB831 | WSGYCEMNDHWDYCYGPK |

TABLE 18-continued

ErbB2 binding MRDs

| SEQ ID: | Ref. No. | Peptide Sequence |
|---|---|---|
| 3477 | EGB832 | WSGYCEFRDHWDYCGNSY |
| 3478 | EGB834 | WSGYCEFKDHWDYCGNSD |
| 3479 | EGB835 | WSGYCEFKDIIWDFCGGSY |
| 3480 | EGB836 | WSGYCQTNDHWDYCSGTI |
| 3481 | EGB837 | WSGYCESYDHWYHCGGTL |
| 3482 | EGB838 | WSGYCEYEDHWDYCGTWV |
| 3483 | EGB839 | WSGYCEMEDRWAYCSGSI |
| 3484 | EGB840 | WSGYCEFKDHWDHCGGSL |
| 3485 | EGB845 | WSGYCQMKDHWDYCSGSL |
| 3486 | EGB847 | WSGYCEGKEHWYQCGGPL |
| 3487 | EGB848 | WSGYCEFNDHWAHCGGSP |
| 3488 | EGB849 | WSGYCEFKDRWAHCSGSI |
| 3489 | EGB850 | WSGYCEFKGYWDHCGSSK |
| 3490 | EGB851 | WSGYCEYKDRWAIICRGTM |
| 3491 | EGB852 | WSGYCEFKDHWDYCGGSY |
| 3492 | EGB853 | WSGYCEMKDHWAHCSGSI |
| 3493 | EGB854 | WSGYCEYQDHWAHCGRSM |
| 3494 | EGB855 | WSGYCEFSDHWDHCGNSK |
| 3495 | EGB857 | WSGYCEMKDHWAHCGGSI |

TABLE 19

ErbB3 binding MRDs

| SEQ ID: | Ref. No. | Peptide Sequence |
|---|---|---|
| 3499 | EGC1 | VYQLCIKMWVCTWHG |
| 3500 | EGC2 | DLVGCLLFSHVSCFSPL |
| 3501 | EGC3 | PTLSACMEAKCVLIFL |
| 3502 | EGC5 | LLWRCELMPPWPYMCSEVD |
| 3503 | EGC13 | GTQECAQDDYFRYWCLRTW |
| 3504 | EGC14 | LDLCMTIERPHRQCPCG |
| 3505 | EGC19 | LWRWCVWARDCPQSS |
| 3506 | EGC20 | IAREFCMNYQCLRLLR |
| 3507 | EGC21 | SYWVCLTYFICWPSW |
| 3508 | EGC39 | VQQFVHWMESWNPACFWRM |
| 3509 | EGC40 | LLNQCLQWAFHNCGCWN |
| 3510 | EGC44 | LSWWCRMGWFQEYGECNFLF |
| 3511 | EGC48 | WTHACVVWNMKQMEACTSLT |
| 3512 | EGC54 | KVMFCWVMWKQCSSPP |

TABLE 19-continued

ErbB3 binding MRDs

| SEQ ID: | Ref. No. | Peptide Sequence |
|---|---|---|
| 3513 | EGC93 | SLVSCPVHNPIWWSHCMEIM |
| 3514 | EGC94 | GHRLCIWMQNFVDGHCAGLV |
| 3515 | EGC99 | CHVSCPFYNPNWWSHCMELM |
| 3516 | EGC100 | FLEMCMDWNPKTWCYCMEWM |
| 3517 | EGC101 | SFVMCPVYNPKQWSVCMEIL |
| 3518 | EGC102 | LFLMCLVYPSEKWHVCVETL |
| 3519 | EGC104 | SLVKCPFFNPIWWSHCMELM |
| 3520 | EGC106 | WSHACIVYNDKIMGACTCLT |
| 3521 | EGC115 | DQVRCPFQNPVWWSHCMYLL |
| 3522 | EGC117 | PLERCPFQNPLWFSHCMEML |
| 3523 | EGC120 | KFFMCPVYPSNRWAVCVETL |
| 3524 | EGC121 | TFYVCQIYPSGKWHVCVGTC |
| 3525 | EGC122 | RFFMCQVYPSYKWHVCVESW |
| 3526 | EGC123 | KFLMCRLYPSGKWHVCVETL |
| 3527 | EGC125 | LEVYCPFENPIWWARCMELM |
| 3528 | EGC127 | SRVRCPFQNPIWEAHCMKMT |
| 3529 | EGC128 | SQVRCPFQNPIWRNHCMELI |
| 3530 | EGC129 | PKVRCPFQNPIWWSHCMEML |
| 3531 | EGC130 | NFVMCQVYPSYTWHVCVGTL |
| 3532 | EGC132 | KFMICRLYPSGNLHICVETS |
| 3533 | EGC133 | TFMMCQVYPSLKWHVCIETG |
| 3534 | EGC134 | RFVMCQVYPSLNWHVCVQTL |
| 3535 | EGC135 | SPVRCPFQNPIWYAHCMKIT |
| 3536 | EGC136 | SKVYCPFQNPIWFAKCIELM |
| 3537 | EGC138 | PQVRCPFQNPIWYSHCMKLM |
| 3538 | EGC139 | TQVRCPFQNPIWWSHCMEML |
| 3539 | EGC140 | KLMLCQVYPSLKWHVCVEAS |
| 3540 | EGC141 | NFLMCQVYPSYKWHVCVEQL |
| 3541 | EGC142 | RFLVCQVYPSLKWHVCVEKS |
| 3542 | EGC143 | TFFICQVYPSGKWHVCVDTV |
| 3543 | EGC144 | GFIMCQVYPSENWHVCLDRG |
| 3544 | EGC145 | KFIMCQVYPSERWHVCLETM |
| 3545 | EGC150 | SDVYCPFSNPAWWVHCMEML |
| 3546 | EGC151 | TQVYCPFANPVWWNIICMLLS |
| 3547 | EGC152 | KFFMCQIYPSLKWHVCVEKL |
| 3548 | EGC153 | KFVMCQVYPSEKWHVCIAPL |
| 3549 | EGC154 | QFFMCQVYPSLRWSVCQVTL |
| 3550 | EGC155 | GFVMCQVYPSQKWHVCLDTF |
| 3551 | EGC156 | GFHMCQVYPSGKWLVCLHPR |
| 3552 | EGC157 | EFYMCQVYPSELWHVCVDKL |
| 3553 | EGC158 | FKERCPFQNPIWYSRCMELI |
| 3554 | EGC159 | SSVRCPFQNPIWWSHCMELL |
| 3555 | EGC160 | SEIRCPFKNPIWYAHCMKLI |
| 3556 | EGC161 | SQVRCPFQNPIWYTHCMELL |
| 3557 | EGC163 | SQVYCPFIINPIWLAIICMELM |
| 3558 | EGC164 | KFILCQVYPSGKWHICTETL |
| 3559 | EGC165 | NLLLCKVYPSGKWHVCFAPL |
| 3560 | EGC166 | KFQLCQVYPSERWHICVVTL |
| 3561 | EGC167 | NFYMCKVYPSELWHVCVETL |
| 3562 | EGC168 | RFVMCQVYPSAKWHVCVETL |
| 3563 | EGC169 | TNIRCPFQNPIWYSHCIALT |
| 3564 | EGC171 | SPVRCPFQNPIWYEHCMALI |
| 3565 | EGC172 | SAVRCPFFTNPIWYSHCMKLL |
| 3566 | EGC174 | AQVRCPFQNPVWYSHCMDLI |
| 3567 | EGC175 | YFRMCQVYPSLKWHICVETM |
| 3568 | EGC176 | GFFMCQVYPSEKWHVCLETL |
| 3569 | EGC177 | GFIMCQVYPSLKWHVCVETS |
| 3570 | EGC178 | KFFMCQIYPSEKWHVCVKLW |
| 3571 | EGC181 | AASLCPFQNPIWLAHCMEMM |
| 3572 | EGC182 | SKVYCPFQNPIWWSHCMELI |
| 3573 | EGC183 | SQAYCPFQNPIWWNHCMELI |
| 3574 | EGC185 | HLFLCQVYPSEKWHVCVETL |
| 3575 | EGC186 | KFRMCQVYPSGKWHVCAETF |
| 3576 | EGC187 | KFFLCQVYPSGKYHICVSTW |
| 3577 | EGC189 | KFYMCQVYPSVRWHVCVDTS |
| 3578 | EGC191 | TREICPFQNPIWRSIICLKLV |
| 3579 | EGC192 | PMVRCPFKNPVWYSHCLELL |
| 3580 | EGC196 | TFFMCQVYPSGKWHVCVGGL |
| 3581 | EGC197 | KFFLCQVYPSEKWHVCIERL |
| 3582 | EGC198 | RYQMCQVYPSGKWHVCMETT |
| 3583 | EGC199 | RFQMCKVYPSERWHVCVEIL |
| 3584 | EGC222 | WCTECMRRFPGHYCVAFC |
| 3585 | EGC223 | RAASCLDVFHWCHSWC |
| 3586 | EGC224 | CLSRCVDWVFSNCTSGR |
| 3587 | EGC225 | FLMLCHVSKYTIKCFSPL |

TABLE 19-continued

ErbB3 binding MRDs

| SEQ ID: | Ref. No. | Peptide Sequence |
|---|---|---|
| 3588 | EGC226 | WALACSWTPRWHQCIFSL |
| 3589 | EGC227 | LERLCMEIFYVHCSGSI |
| 3590 | EGC228 | SWRMCIEMFLTHDECVRFV |
| 3591 | EGC229 | SSVVCVRGIHAWTCHFFV |
| 3592 | EGC232 | LTSSCVYVYNWCAVWA |
| 3593 | EGC233 | YRHLCVWLMEQCETAR |
| 3594 | EGC234 | RAASCLDVFHCRRSWS |
| 3595 | EGC236 | HVSICWGYTYCWQIF |
| 3596 | EGC237 | RGASCLDLFHWCHSWG |
| 3597 | EGC238 | IYILCTNFKPVFWCVFST |
| 3598 | EGC239 | LWIRCSLLQYSYYCSWVW |
| 3599 | EGC242 | SYLFCYTLYIDYNCWLWS |
| 3600 | EGC243 | PGYRCVFQVNYQCGAAF |
| 3601 | EGC244 | TIIRCFWTFHMDFVCVTGV |
| 3602 | EGC245 | WLNCGCVVITCIVEPR |
| 3603 | EGC246 | WGWRCYQSWSYQDCQYWY |
| 3604 | EGC248 | FLMLCRVSKYTIKCFSPL |
| 3605 | EGC250 | RGRDCLRSFPGHYCVTFR |
| 3606 | EGC251 | LNYICWRWAHQVPWQCSLFQ |
| 3607 | EGC252 | ASYSCWWGPMYMECWTKV |
| 3608 | EGC253 | KTGSCQAQKVFSWCAQWC |
| 3609 | EGC254 | KFFMCQVYPSLKWHVCMETL |
| 3610 | EGC255 | KFMMCQVYPSLKWHVCVETL |
| 3611 | EGC256 | VEHLCSKIPFWHVQCLARF |
| 3612 | EGC259 | KFLMCQVYPSLKWHVCMETL |
| 3613 | EGC263 | QFLMCQVYPSLKWHVCVETL |
| 3614 | EGC264 | QFMLCQVYPSKKWHVCVVPV |
| 3615 | EGC265 | GSCALKNRSKCARRG |
| 3616 | EGC266 | KFQMCQVYPSGNWHVCVETM |
| 3617 | EGC267 | RERTCVYFHKILHDFCPSRT |
| 3618 | EGC268 | FKFTCYWAPYHTFCNTGQ |
| 3619 | EGC269 | KFFMCQVYPSLKWHVWMETL |
| 3620 | EGC270 | KFQCARFTLPETGMFVSKL |
| 3621 | EGC272 | WYEQCMKRHHPQAFCLRFN |
| 3622 | EGC273 | KFLMCQVYPSKKWHVCIETL |
| 3623 | EGC274 | QFMLCQVYPSKKWHVCVVTV |
| 3624 | EGC276 | CLGSCMLKGFERWCIIIGII |
| 3625 | EGC277 | KFFMCVDYPSLKWDVCMETL |
| 3626 | EGC278 | RFFMCVDYPSIKWDVCPETI |
| 3627 | EGC280 | PRWTCEWYQARQSCSLGQ |
| 3628 | EGC281 | KFHMCQVYPSRNWHVWVETL |
| 3629 | EGC283 | VEHLCSEIPFWNVQCLARF |
| 3630 | EGC284 | KLFLCQVYPSERWHVCVESL |
| 3631 | EGC285 | HLIMCQVYPSGKWHVCLATT |
| 3632 | EGC286 | AVELCFHHTQEWTYCLWRF |
| 3633 | EGC287 | GEQLCSKIPSSDALWWVRLL |
| 3634 | EGC288 | DALRCFEWVKRNCLLSS |
| 3635 | EGC289 | KFMMCQVYPSQKWHVCVETF |
| 3636 | EGC291 | VEHLCSKIPFWHVQCLARI |
| 3637 | EGC337 | RYFYMCQVYPSERWQVCVGTS |
| 3638 | EGC453 | SNLYLCQVYPSGKYIIICIEAL |
| 3639 | EGC465 | YSEPYCPFLNPTWKNECIARS |
| 3640 | EGC466 | TSEPYCPFLNPIWKAECISRT |
| 3641 | EGC467 | SYEPYCPFLNPTWKEQCIIRS |
| 3642 | EGC468 | LNEPYCPFMNPNWKAECLARM |
| 3643 | EGC469 | SKGPYCPFLNPIWKDECIARI |
| 3644 | EGC470 | NSEPYCPFINPIWKAECIART |
| 3645 | EGC471 | QSKPYCPFLNPTWKAQCIARS |
| 3646 | EGC472 | TSTPYCPFLNPIWKAECLSRI |
| 3647 | EGC474 | ISEPYCPFMNPTWKEQCLART |
| 3648 | EGC476 | VNDPYCPFLNPTWKAECIART |
| 3649 | EGC488 | SIEPYCPFLNPTWKAECLVRS |
| 3650 | EGC489 | VSEPYCPFLNPVWKDQCLSRI |
| 3651 | EGC490 | LPPPCYWTTWGKECQMFD |
| 3652 | EGC491 | KTEPYCPFLNPTWKAECIART |
| 3653 | EGC492 | TSDPYCPFVNPIWYNECIART |
| 3654 | EGC494 | TGSPYCPFLNPTWKAHCIARL |
| 3655 | EGC500 | ASEPYCPFLNPTWKDCMARL |
| 3656 | EGC501 | RSEPYCPFLNPTWKAQCIYRT |
| 3657 | EGC502 | SIDPYCPFLNPTWLKECIARS |
| 3658 | EGC508 | IGEPYCPFANPTWKQECIART |
| 3659 | EGC511 | WSEPYCPFLNPAWKDQCLART |
| 3660 | EGC512 | MREPYCPFLNPTWKDQCIAIR |
| 3661 | EGC514 | YREPYCPFLNPIWKEQCIARS |
| 3662 | EGC515 | ISAPYCPFLNPIWKDECIART |

TABLE 19-continued

ErbB3 binding MRDs

| SEQ ID: | Ref. No. | Peptide Sequence |
|---|---|---|
| 3663 | EGC516 | LREPYCPFLNPIWNVECLARS |
| 3664 | EGC517 | SSEPYCPFHNPTWKDQCLARS |
| 3665 | EGC518 | DSEPYCPFLNPTWKDQCLARF |
| 3666 | EGC519 | NSEPYCPFLNPSWKASCIARM |
| 3667 | EGC522 | TSEPYCPFLNPIWKDQCIART |
| 3668 | EGC523 | RSEPYCPFLNPIWKNECIARS |
| 3669 | EGC524 | FSEPYCPFIPTWKAQCLARI |
| 3670 | EGC525 | LNEPYCPFLNPIWKDECLART |
| 3671 | EGC526 | SREIYCPFLNPIWLAECIARA |
| 3672 | EGC528 | LTEPYCPFLNPTWKDQCLARR |
| 3673 | EGC529 | SKDPYCPFVNPIWKHECIVRS |
| 3674 | EGC532 | HSEPYCPFLNPIWKEQCMVRS |
| 3675 | EGC533 | SSEPYCPFLNPTWKIIECLLRT |
| 3676 | EGC534 | ESEPYCPFTNPTWKAQCIARS |
| 3677 | EGC535 | YNEPYCPFINPIWKAECIART |
| 3678 | EGC536 | ISEPYCPFQNPTWKFQCLIRS |
| 3679 | EGC538 | RSEPYCPFLNPTWKEQCIARQ |
| 3680 | EGC539 | GRETYCPFLNPIWKAQCLART |
| 3681 | EGC540 | KSEPYCPFLNPIWKDQCIVRS |
| 3682 | EGC541 | VIEPYCPFLNPTWKDHCIART |
| 3683 | EGC542 | MSDPYCPFQNPIWKAACIART |
| 3684 | EGC544 | ESEPYCPFVNPIWKAECIARH |
| 3685 | EGC546 | YNEPYCPFVNPTWKAACVART |
| 3686 | EGC548 | YSKPYCPFINPIWKEQCIARH |
| 3687 | EGC554 | LIEPYCPFLNPTWYDQCIARS |
| 3688 | EGC557 | REVPYCPFLNPIWKEQCIIRT |
| 3689 | EGC561 | SLQAYCPFVNPTWKNECIARI |
| 3690 | EGC563 | LSEAYCPFLNPTWKQHCIALT |
| 3691 | EGC564 | MSEPYCPFLNPTWKEQCLARS |
| 3692 | EGC565 | LNEPYCPFLNPIWKNQCIARL |
| 3693 | EGC566 | PSKPYCPFLNPYWKAECMSRS |
| 3694 | EGC568 | ISEPYCPFLNPTWKDACIARS |
| 3695 | EGC570 | PDSWCHTLYWDLLYCVNQE |
| 3696 | EGC572 | QGQPYCPFVNPIWYAECMTRT |
| 3697 | EGC578 | RPEPYCPFKNPNWKEQCLARY |
| 3698 | EGC579 | SSEPYCPFINPTWKQECIART |
| 3699 | EGC582 | TTEPYCPFLNPIWKDQCIARW |
| 3700 | EGC583 | VSEPYCPFLNPYWKDQCIARH |
| 3701 | EGC584 | YNEPYCPFLNPTWKDQCLARI |
| 3702 | EGC585 | RSEPYCPFYNPIWYDHCVALT |
| 3703 | EGC586 | NPEPYCPFLNPIWKEQCILRS |
| 3704 | EGC589 | LSGLYCPFLNPTWKDQCIARM |
| 3705 | EGC590 | ISQPYCPFTNPTWLAECIARS |
| 3706 | EGC592 | LNTPYCPFINPTWKDECLARS |
| 3707 | EGC594 | YEEHCRLFPADWICSLLQ |
| 3708 | EGC595 | NSEPYCPFLNPSWKAQCIARS |
| 3709 | EGC596 | ADSWCHTLYWNLRHCEIQE |
| 3710 | EGC597 | SSEPYCPFLNPTWKEQCIART |
| 3711 | EGC599 | DTKPYCPFLNPIWKNQCIERT |
| 3712 | EGC600 | TRDPYCPFLNPIWKDECFART |
| 3713 | EGC601 | KEEAYCPFLNPLWKDECVART |
| 3714 | EGC602 | PESWCHTLYWNLQHCLSQE |
| 3715 | EGC603 | MSEPYCPFQNPTWKIIECIART |
| 3716 | EGC604 | DSDPYCPFVNPIWKAQCIARS |
| 3717 | EGC605 | YSEPYCPFVNPTWLDQCIART |
| 3718 | EGC606 | YSEPYCPFLNPTWKAQCMAMI |
| 3719 | EGC608 | LSEPYCPFLNPTWKAACLARI |
| 3720 | EGC609 | IRKPYCPFLNPTWYNECIQRS |
| 3721 | EGC610 | QGEPYCPFLNPAWKDACIERL |
| 3722 | EGC612 | GSEPYCPFFNPIWKDQCITRF |
| 3723 | EGC613 | RSEPYCPFLNPTWKEHCIART |
| 3724 | EGC614 | TNEPYCPFLNPTWKQQCIART |
| 3725 | EGC615 | TSEPYCPFENPIWKAQCISRS |
| 3726 | EGC616 | KSEPYCPFLNPYWKDQCIARS |
| 3727 | EGC617 | LREPYCPFLNPTWKAECIARI |
| 3728 | EGC619 | TNDPYCPFLNPTWKAQCLDRY |
| 3729 | EGC620 | KGQPYCPFLNPIWKEQCLART |
| 3730 | EGC621 | SSEAYCPFLNPTWKQECIARL |
| 3731 | EGC623 | ANSWCHTLYWDLMYCVWQE |
| 3732 | EGC624 | TIEPYCPFLNPIWKDQCIARS |
| 3733 | EGC625 | QHEPYCPFLNPVWKHECIART |
| 3734 | EGC626 | IREPYCPFLNPTWKAQCIART |
| 3735 | EGC627 | HSAPYCPFLNPIWKDECIARS |
| 3736 | EGC628 | VSEPYCPFLNPTWKAHCIELS |
| 3737 | EGC629 | SSDPYCPFLNPTWYDQCIERY |

TABLE 19-continued

ErbB3 binding MRDs

| SEQ ID: | Ref. No. | Peptide Sequence |
|---|---|---|
| 3738 | EGC630 | ISDPYCPFVNPYWKAECIART |
| 3739 | EGC631 | NIDPYCPFLNPTWKAECIARI |
| 3740 | EGC632 | PREPYCPFLNPLWKNQCIERT |
| 3741 | EGC634 | IRVPYCPFQNPTWYDQCIART |
| 3742 | EGC635 | PDSWCHTLYWHLQHCLSQE |
| 3743 | EGC636 | TNDPYCPFLNPTWKAECIARH |
| 3744 | EGC637 | VSEPYCPFLNPTWKAQCLNRI |
| 3745 | EGC638 | PIDPYCPFLNPIWKEQCHARS |
| 3746 | EGC639 | VREPYCPFLNPTWKNECIART |
| 3747 | EGC640 | LIEPYCPFLNPIWKDQCLART |
| 3748 | EGC641 | PKFFMCQVYPSGKWHVCTGTV |
| 3749 | EGC642 | PKYYMCQIYPSLKWNVCLETL |
| 3750 | EGC644 | LNFYICKLYPSANLHVCVDTL |
| 3751 | EGC646 | RSEPYCPFLNPVWKDQCIARS |
| 3752 | EGC647 | SSEPYCPFLNPIWKYHCIARS |
| 3753 | EGC648 | PGSPYCPFLNPFWKEQCIVRT |
| 3754 | EGC649 | YEEHCALFPTDWICTLH |
| 3755 | EGC651 | FIEPYCPFINPTWKAECLART |
| 3756 | EGC652 | DKFYLCQIYPSERWHVCVWSS |
| 3757 | EGC653 | EKFKMCQIYPSKNWAVCVETF |
| 3758 | EGC654 | HKFYMCQVYPSEKWHVCVETL |
| 3759 | EGC655 | LSEPYCPFLNPSWKAECIARS |
| 3760 | EGC656 | LSEPYCPFLNPIWKEQCIARS |
| 3761 | EGC657 | LSEPYCPFLNPTWKDQCIARS |
| 3762 | EGC658 | RSEPYCPFVNPIWKAECIVRS |
| 3763 | EGC659 | QFEPYCPFLNPTWKEQCIARI |
| 3764 | EGC660 | PIEPYCPFQNPTWKAQCIART |
| 3765 | EGC661 | YRQPYCPFLNPTWKAQCMART |
| 3766 | EGC663 | DNFYMCQVYPSLKWIIICVSIL |
| 3767 | EGC664 | SMFFMCQVYPSEKWHVCVYPL |
| 3768 | EGC665 | SKFFMCQVYPSERWHVCIEPL |
| 3769 | EGC666 | LKFYMCQVYPSGNWNVCTATQ |
| 3770 | EGC667 | NSEPYCPFHNPTWKAACMART |
| 3771 | EGC668 | RSEPYCPFLNPIWKEQCIART |
| 3772 | EGC669 | SREPYCPFLNPTWKEQCIARI |
| 3773 | EGC671 | MREPYCPFLNPSWKEQCIARS |
| 3774 | EGC672 | LREPYCPFLNPVWKNECIART |
| 3775 | EGC673 | ITDTYCPFQNPIWKAECIART |
| 3776 | EGC674 | FNFFMCQVYPSEKWHICVKSL |
| 3777 | EGC675 | KKFYMCQIYPSEKWHVCVERI |
| 3778 | EGC676 | TRYSMCQVYPSLRWIIICVENL |
| 3779 | EGC678 | LGEPYCPFLNPTWKAQCLYMS |
| 3780 | EGC679 | SSEPYCPFLNPIWKNECLARQ |
| 3781 | EGC680 | RSEPYCPFLNPIWKEHCINRS |
| 3782 | EGC681 | HSQPYCPFQNPTWYEQCIART |
| 3783 | EGC682 | SNEPYCPFLNPSWKDACLQRT |
| 3784 | EGC683 | LSDVYCPFVNPTWKAECIARS |
| 3785 | EGC684 | SDFFMCQVYPSQKWHVCVKSL |
| 3786 | EGC686 | PDSWCHTLYWSLLHCARQE |
| 3787 | EGC687 | LPFFMCQVYPSKSWHVCVETS |
| 3788 | EGC688 | LSEPYCPFQNPTWKEQCVARS |
| 3789 | EGC689 | ADSWCHTLFWNLKHCLIQE |
| 3790 | EGC690 | GGDPYCPFLNPTWKAECIART |
| 3791 | EGC691 | VREPYCPFLNPIWKDQCIART |
| 3792 | EGC692 | ASEPYCPFLNPIWKDQCIART |
| 3793 | EGC693 | SSEPYCPFQNPTWKDQCIARN |
| 3794 | EGC694 | ADSWCHTLYWNLLYCANQE |
| 3795 | EGC696 | SWFFMCQIYPSLKWHVCVETL |
| 3796 | EGC698 | STFYMCKVYPSQRWHVCVDTL |
| 3797 | EGC700 | SREPYCPFLNPTWYDECIART |
| 3798 | EGC701 | QSEPYCPFLNPMWKEQCIVRI |
| 3799 | EGC702 | TSEPYCPFDNPTWKARCLAML |
| 3800 | EGC703 | ARQPYCPFLNPTWKNECMARS |
| 3801 | EGC704 | PSEPYCPFLNPIWKAECIART |
| 3802 | EGC705 | IAILTALSLTLSGRTSASSE |
| 3803 | EGC706 | YSAPDCPFVNPIWKNACIARY |
| 3804 | EGC707 | ADSWCHTLFWQLQHCVWQE |
| 3805 | EGC708 | LNFSMCQVYPSYKWHVCVGTL |
| 3806 | EGC709 | MEFFMCQVYPSEKWHVCVAKL |
| 3807 | EGC710 | LRYYICQIYPSEKYHVCVDTL |
| 3808 | EGC711 | VIEPYCPFLNPTWKAECLARS |
| 3809 | EGC712 | STEPYCPFLNPIWKDACIARH |
| 3810 | EGC715 | WRDPYCPFLNPIWKEQCIARY |
| 3811 | EGC716 | RSEPYCPFLNPTWKDQCMART |
| 3812 | EGC717 | VIDPYCPFLNPIWKEQCQVRT |

TABLE 19-continued

ErbB3 binding MRDs

| SEQ ID: | Ref. No. | Peptide Sequence |
|---|---|---|
| 3813 | EGC718 | SKFFMCQVYPSKKWHVCVEAL |
| 3814 | EGC719 | IKFFMCQVYPSELWHVCVQKQ |
| 3815 | EGC720 | TTFFMCQLYPSGNWHVCTETL |
| 3816 | EGC721 | FKFFMCQTYPSEKWIIVCVEKL |
| 3817 | EGC722 | SSEPYCPFLNPLWHEQCLARI |
| 3818 | EGC723 | AREPYCPFLNPIWKAECVARY |
| 3819 | EGC724 | PSEPYCPFVNPTWLDECIARS |
| 3820 | EGC725 | ASEPYCPFLNPTWYEQCINRT |
| 3821 | EGC726 | PISPYCPFLNPIWYEECIARS |
| 3822 | EGC727 | VGEPYCPFMNPIWKEQCILRS |
| 3823 | EGC729 | ADSWCHTLYWQLLHCVNQE |
| 3824 | EGC736 | ADSWCHTLYWQLLHCVSQE |
| 3825 | EGC737 | DQVRCPFQNPVWWSHCMYLL |
| 3826 | EGC745 | DQVRCPFQNPVWWSHCMYLL |
| 3827 | EGC746 | DQVRCPFQNPVWWSHCMYLL |
| 3828 | EGC752 | YTKHCQRLPTYKICNLFM |
| 3829 | EGC754 | DQVRCPFQNPVWWSHCMYLL |
| 3830 | EGC755 | ADSWCHTLYWQLQHCLSQE |
| 3831 | EGC759 | DQVRCPFQNPVWWSHCMYLL |
| 3832 | EGC763 | DQVRCPFQNPVWWSIICMYLL |
| 3833 | EGC764 | DQVRCPFQNPVWWSHCMYLL |
| 3834 | EGC765 | TDSWCHTLYWQLHHCAILE |
| 3835 | EGC770 | DQVRCPFQNPVWWSHCMYLL |
| 3836 | EGC771 | YQVTCPFLNPPWWSHCMYLL |
| 3837 | EGC772 | DQVRCPFQNPVWWSHCMYLL |
| 3838 | EGC776 | HRAPCFSCTACRQPCFSLT |
| 3839 | EGC777 | YQVTCPFFNPLWWSHCMYLL |
| 3840 | EGC783 | SEPYCPFLNPTWKSQCIART |
| 3841 | EGC789 | YEVQCPFQNPIWWKHCMDLI |
| 3842 | EGC791 | ESCWTWDHWYQYWVPQRCDP |
| 3843 | EGC792 | ANSWCHTLYWQLHHCEILE |
| 3844 | EGC793 | QACNFTSLGWYQEFYCLR |
| 3845 | EGC794 | WACRWEWHAAWQKWDEFCVE |
| 3846 | EGC795 | AYCYRSIISRNSTCSAL |
| 3847 | EGC796 | VYCFLNFKTMNYAGEFWCRH |
| 3848 | EGC797 | SWCMWYYESTYSAPYYYCSV |
| 3849 | EGC798 | SQCHWWHEPYGMFQTEICLW |
| 3850 | EGC799 | GLHGCQYVQMFFHFCAPKT |
| 3851 | EGC800 | WQHVCWQDWYSWVCTSGY |
| 3852 | EGC801 | PWRGCWWDPWQPWDCVPFF |
| 3853 | EGC802 | QERLCRQIWQIIYCVRYM |
| 3854 | EGC803 | QPRECNYVPAWYCHYYS |
| 3855 | EGC804 | VYQYHCDWYTCLFRHT |
| 3856 | EGC806 | FQGHCALFPTDWICTLKS |
| 3857 | EGC807 | QMCHMEWHNHVYWQVCHW |
| 3858 | EGC808 | WMRQCHLETECQRAS |
| 3859 | EGC809 | SAVACFHPPYFFICVASG |
| 3860 | EGC810 | LRRRCHSRFMQCSNPG |
| 3861 | EGC811 | GQTWCHWGMYCISTT |
| 3862 | EGC818 | WEYQCEWGYSYKPQCWLSA |
| 3863 | EGC820 | LPLTCWVLEWHEWLACVSYD |
| 3864 | EGC822 | WSYSCVFLPWMYHMCYLET |
| 3865 | EGC823 | WFYQCWQSPWHTECSWVN |
| 3866 | EGC824 | RDQPCWYKIMTGCLCMP |
| 3867 | EGC825 | LPPSWCVRGECSWLLL |
| 3868 | EGC826 | DESDCKQLPICHGHCLVPL |
| 3869 | EGC827 | YQVFCEWSYWEYHCISNQ |
| 3870 | EGC828 | VQHCLYRQHSYRECVRHY |
| 3871 | EGC829 | YIDCVPVLPGFYLPQLG |
| 3872 | EGC831 | WHQACEYQYYNWECSMGW |
| 3873 | EGC832 | ETFSCYVFPFFYECYSTP |
| 3874 | EGC836 | WTNLFCWGPLCKCLQQ |
| 3875 | EGC839 | YQVMCLHQPFVSFCHYET |
| 3876 | EGC840 | GTHWCRYYPSYAECYVWL |
| 3877 | EGC841 | TWLCDCSYWGCWWELG |
| 3878 | EGC842 | LWVGCYIPPWTEWCPIAW |
| 3879 | EGC844 | VWLMCWHYIFCPSKL |
| 3880 | EGC845 | PEYLCWVYPYAPQCWDLV |
| 3881 | EGC846 | VEHLCSKIPFWMFSAWPG |
| 3882 | EGC849 | ICEACPKIIVSEQCIRLR |
| 3883 | EGC851 | WRVICMARPTGEQCEWVW |
| 3884 | EGC854 | DWSKCIQFSLPHDHCLMFM |
| 3885 | EGC856 | SRWECAWIVGYHHWDCRWLF |
| 3886 | EGC857 | SMEYCFWYHYCQLGV |
| 3887 | EGC858 | IFVMCEDSWPVPFCFSNR |

TABLE 19-continued

ErbB3 binding MRDs

| SEQ ID: | Ref. No. | Peptide Sequence |
|---|---|---|
| 3888 | EGC859 | VEWMCYAYPFDPECYYNW |
| 3889 | EGC861 | DEHLCSISRSGMSFAWAG |
| 3890 | EGC862 | ASEPYCPFLNPVWKEQCIARL |
| 3891 | EGC863 | PREPYCPFHNPIWKNQCIART |
| 3892 | EGC865 | ESEPYCPFLNPIWKAHCIART |
| 3893 | EGC866 | DSEPYCPFLNPIWKEQCLARM |
| 3894 | EGC867 | TSDPYCPFLNPTWKAECIART |
| 3895 | EGC868 | WSEPYCPFTNPTWKAACIARS |
| 3896 | EGC869 | ARDPYCPFQNPIWYNECIART |
| 3897 | EGC870 | PREPYCPFHNPAWKAACVARA |
| 3898 | EGC871 | TNESYCPFLNPTWKAECMARI |
| 3899 | EGC872 | DREPYCPFLNPYWKDQCLART |
| 3900 | EGC873 | ISDPYCPFVNPIWKEQCIARN |
| 3901 | EGC874 | RNEPYCPFVNPIWKEQCIIRT |
| 3902 | EGC875 | LTTPYCPFENPTWKAQCIART |
| 3903 | EGC876 | SIEPYCPFLNPTWLEQCIARS |
| 3904 | EGC877 | KSEPYCPFLNPTWHDQCIARN |
| 3905 | EGC878 | IIGPYCPFLNPEWKDQCMART |
| 3906 | EGC879 | YREPYCPFQNPYWKDQCIARY |
| 3907 | EGC880 | AIEPYCPFLNPIWKDQCLARI |
| 3908 | EGC881 | MSRPYCPFLNPIWKEQCIART |
| 3909 | EGC882 | YNKPYCPFQNPTWKEACLARS |
| 3910 | EGC883 | SSEPYCPFLNPTWKAECIARS |
| 3911 | EGC884 | LSEPYCPFQNPIWKDKCIAMS |
| 3912 | EGC885 | SYEPYCPFLNPTWKAECIARI |
| 3913 | EGC886 | GSEPYCPFLNPTWKEQCIIRT |
| 3914 | EGC888 | SSEPYCPFLNPTWKSQCIARS |
| 3915 | EGC889 | RSEPYCPFLNPIWKDHCIART |
| 3916 | EGC890 | RSEPYCPFLNPTWKAECIARS |
| 3917 | EGC891 | SREPYCPFLNPIWKDKCISRT |
| 3918 | EGC892 | TSDPYCPFLNPIWKEQCIVRT |
| 3919 | EGC893 | EREPYCPFLNPTWKEQCLARH |
| 3920 | EGC894 | LREPYCPFLNPTWKAECIARS |
| 3921 | EGC895 | GSEPYCPFLNPTWKEQCLARL |
| 3922 | EGC896 | MSEPYCPFLNPIWKEQCIARS |
| 3923 | EGC897 | RGEPYCPFTNPIWKEQCINRS |
| 3924 | EGC898 | DADPYCPFLNPTWKAECLARS |
| 3925 | EGC899 | RGEPYCPFLNPAWKNECLART |
| 3926 | EGC900 | IIEPYCPFVNPNWKAQCIARS |
| 3927 | EGC901 | EDEPYCPFLNPIWKAQCLART |
| 3928 | EGC902 | FTEPYCPFINPTWKAECIARS |
| 3929 | EGC903 | TSEPYCPFLNPIWKEQCITRT |
| 3930 | EGC904 | VEPYCPFLNPTWKDACLART |
| 3931 | EGC905 | TSEPYCPFGNPIWKKECIART |
| 3932 | EGC906 | TSEPYCPFLNPTWKDECIARM |
| 3933 | EGC907 | SNEPYCPFLNPTWKAQCLARM |
| 3934 | EGC908 | YREPYCPFLNPTWKEQCIARS |
| 3935 | EGC909 | LNAPYCPFLNPNWYDQCIHRS |
| 3936 | EGC910 | SSDPYCPFLNPTWKQQCIERS |
| 3937 | EGC911 | ASEPYCPFLNPTWKEQCIART |
| 3938 | EGC912 | LSEPYCPFQNPTWYDECISRS |
| 3939 | EGC913 | SSEPYCPFLNPKWKHECIARS |
| 3940 | EGC914 | GSEPYCPFLNPIWKAECIARS |
| 3941 | EGC915 | RIEPYCPFVNPTWKDQCLART |
| 3942 | EGC916 | SIEPYCPFLNPTWKEQCIARS |
| 3943 | EGC917 | RTEPYCPFLNPTWKEQCIARS |
| 3944 | EGC918 | PSEPYCPFLNPTWKDQCLQRS |
| 3945 | EGC919 | YSEPYCPFLNPTWKAECIART |
| 3946 | EGC920 | TSEPYCPFLNPTWKEHCMART |
| 3947 | EGC921 | GSNPYCPFLNPIWKEACLART |
| 3948 | EGC922 | INEPYCPFQNPFWYAECLART |
| 3949 | EGC923 | TREPYCPFLNPTWLDQCIART |
| 3950 | EGC924 | IREPYCPFLNPSWKAECIARS |
| 3951 | EGC925 | ASEPYCPFINPTWKDECIARS |
| 3952 | EGC926 | HSEPYCPFLNPTWKEQCTARS |
| 3953 | EGC927 | MKEPYCPFLNPTWKAQCIART |
| 3954 | EGC928 | TDETYCPFKNPIWYEECIARS |
| 3955 | EGC929 | RGEPYCPFKNPTWKYQCLART |
| 3956 | EGC930 | IREPYCPFLNPIWKAHCIALT |
| 3957 | EGC931 | VSEPYCPFMNPIWKAECLSRT |
| 3958 | EGC932 | EREPYCPFLNPIWLEQCLSRT |
| 3959 | EGC933 | YSEPYCPFLNPIWKEQCIART |
| 3960 | EGC934 | FGEPYCPFLNPTWKAECLVRS |
| 3961 | EGC935 | LREPYCPFLNPTWKEQCLVRT |
| 3962 | EGC936 | STDPYCPFLNPVWNYQCIART |

TABLE 19-continued

ErbB3 binding MRDs

| SEQ ID: | Ref. No. | Peptide Sequence |
|---|---|---|
| 3963 | EGC937 | SHEPYCPFQNPIWKAECLART |
| 3964 | EGC938 | LNDPYCPFLNPIWKEQCMSRY |
| 3965 | EGC939 | GYAPYCPFLNPIWKNECITRT |
| 3966 | EGC940 | FSEPYCPFVNPYWKEQCIART |
| 3967 | EGC941 | HTEPYCPFLNPTWKEQCLARF |
| 3968 | EGC942 | GYEPYCPFLNPIWKAECKARS |
| 3969 | EGC944 | LREAYCPFINPIWKDQCMARI |
| 3970 | EGC945 | LIEPYCPFLNPHWKAECIARY |
| 3971 | EGC946 | SSEPYCPFINPMWKDQCLART |
| 3972 | EGC947 | PSDPYCPFLNPSWKAECLART |
| 3973 | EGC948 | SSEPYCPFLNPIWKAECIARA |
| 3974 | EGC949 | FPEPYCPFLNPHWKAQCLERL |
| 3975 | EGC950 | FREPYCPFLNPTWKQQCLARI |
| 3976 | EGC951 | PREPYCPFLNPIWKDECIART |
| 3977 | EGC952 | MSDPYCPFLNPTWKAQCIART |
| 3978 | EGC954 | NSEPYCPFSNPTWKDECLIRS |
| 3979 | EGC955 | LREPYCPFLNPTWKEQCIARY |
| 3980 | EGC956 | HNKTYCPFLNPTWKAQCIART |
| 3981 | EGC957 | IGEPYCPFLNPTWKEECIRRT |
| 3982 | EGC958 | ISEPYCPFINPTWKAECIARS |
| 3983 | EGC959 | TKAPYCPFKNPIWKAECIART |
| 3984 | EGC960 | PGDPYCPFLNPIWKQECIVRN |
| 3985 | EGC961 | STEPYCPFSNPTWKAQCIARI |
| 3986 | EGC962 | RSEPYCPFLNPTWKDQCIARS |
| 3987 | EGC963 | SSEPYCPFLNPIWKEHCIART |
| 3988 | EGC964 | YREPYCPFLNPIWKEQCIART |
| 3989 | EGC965 | HSEPYCPFVNPTWYNECISRT |
| 3990 | EGC966 | RSEPYCPFLNPIWKDQCIARS |
| 3991 | EGC967 | VNEPYCPFLNPKWYAECLART |
| 3992 | EGC968 | QNDPYCPFLNPIWKAQCIARS |
| 3993 | EGC969 | SSEPYCPFLNPYWKEQCIART |
| 3994 | EGC970 | YREPYCPFLNPYWKDQCMART |
| 3995 | EGC972 | MHEPYCPFINPTWYEQCLARS |
| 3996 | EGC973 | QLKPYCPFLNPIWYDQCVSRT |
| 3997 | EGC974 | SSEPYCPFLNPSWKDQCIARL |
| 3998 | EGC975 | YIDPYCPFLNPTWKDACLARS |
| 3999 | EGC976 | SSEIIYCPFVNPAWKEACIARY |
| 4000 | EGC977 | QSEPYCPFVNPTWKNECIARY |
| 4001 | EGC978 | LSDPYCPFLNPIWKDQCIART |
| 4002 | EGC979 | LGEPYCPFINPTWKAECLART |
| 4003 | EGC980 | YGDPYCPFLNPTWKENCTART |
| 4004 | EGC981 | LTEPYCPFLNPTWKDECLART |
| 4005 | EGC982 | FREPYCPFKNPTWLAQCIARS |
| 4006 | EGC983 | ANEPYCPFLNPHWKGQCVLRS |
| 4007 | EGC984 | LNEPYCPFNNPTWKEECIKRS |
| 4008 | EGC985 | QSEPYCPFLNPTWYTECVART |
| 4009 | EGC986 | SSQPYCPFLNPTWKDACLART |
| 4010 | EGC988 | SHEPYCPFLNPEWKAECIARN |
| 4011 | EGC989 | ASDPYCPFLNPIWKDQCILRS |
| 4012 | EGC990 | DNDPYCPFLNPTWKEECVARS |
| 4013 | EGC991 | ESEPYCPFVNPIWKDQCMARY |
| 4014 | EGC992 | LSAPYCPFLNPTWKDQCLART |
| 4015 | EGC993 | SSEPYCPFLNPIWKQACYDRT |
| 4016 | EGC994 | VDEPYCPFLNPNWKEACIARS |
| 4017 | EGC995 | LIEPYCPFLNPTWKEQCFVRS |
| 4018 | EGC996 | NDEPYCPFLNPIWKAQCLARN |
| 4019 | EGC997 | AGKPYCPFLNPSWYDECIRRL |
| 4020 | EGC998 | LSEPYCPFLNPIWKDQCMIRS |
| 4021 | EGC999 | STEPYCPFLNPTWKDQCIARI |
| 4022 | EGC1000 | PREPYCPFLNPVWKAQCIARW |
| 4023 | EGC1001 | ISAPYCPFKNPIWKAECIARS |
| 4024 | EGC1003 | IGEPYCPFLNPTWKDQCLVRS |
| 4025 | EGC1004 | SSVPYCPFKNPTWKAECIART |
| 4026 | EGC1005 | YREPYCPFLNPLWKDECIART |
| 4027 | EGC1006 | HSEPYCPFLNPTWKDECITRT |
| 4028 | EGC1007 | YSDPYCPFLNPSWYDECVSRM |
| 4029 | EGC1008 | YREPYCPFLNPTWYECIARS |
| 4030 | EGC1009 | HREPYCPFLNPAWKEQCLVRS |
| 4031 | EGC1010 | ASEPYCPFLNPTWRDACLART |
| 4032 | EGC1011 | LREPYCPFLNPTWKEQCIARS |
| 4033 | EGC1012 | SSEPYCPFLNPTWYNECIYRI |
| 4034 | EGC1013 | LREPYCPFENPIWKEKCIAIT |
| 4035 | EGC1014 | PSEPYCPFLNPTWKAECIART |
| 4036 | EGC1015 | ATEPYCPFLNPIWKAQCIERM |
| 4037 | EGC1016 | LGEPYCPFLNPTWKLQCLART |

TABLE 19-continued

ErbB3 binding MRDs

| SEQ ID: | Ref. No. | Peptide Sequence |
|---|---|---|
| 4038 | EGC1017 | ATEPYCPFLNPVWKDQCILRT |
| 4039 | EGC1018 | PIEPYCPFINPMWKAECIART |
| 4040 | EGC1019 | GREPYCPFLNPVWYNECMVRF |
| 4041 | EGC1020 | VIEPYCPFLNPIWKEQCIARS |
| 4042 | EGC1021 | TIEPYCPFLNPTWYKECLLRS |
| 4043 | EGC1022 | LGEPYCPFLNPTWKDQCTARS |
| 4044 | EGC1024 | LNEPYCPFLNPTWKAQCIART |
| 4045 | EGC1025 | WSEPYCPFLNPTWKAECIART |
| 4046 | EGC1026 | ASEPYCPFWNPIWKAQCIARI |
| 4047 | EGC1027 | ISEPYCPFVNPTWKAQCIART |
| 4048 | EGC1028 | VIEPYCPFVNPTWKEQCILRS |
| 4049 | EGC1029 | MSCDEAWYNEQTWLWCVT |
| 4050 | EGC1030 | WQCEWQWVQEWGAWDEFCVM |
| 4051 | EGC1031 | GYCATDYWDYNGVWGTYCTQ |
| 4052 | EGC1032 | RYCYLFEKYAPFYDQCLL |
| 4053 | EGC1033 | RYCYLFQKYAPFYDQCLL |
| 4054 | EGC1034 | GCCYWWGLVYDKWIKCET |
| 4055 | EGC1035 | YQVKCPFQNPVWWSHCMYLL |
| 4056 | EGC1036 | GYCFLFYKFPQYHMQCII |
| 4057 | EGC1037 | KECLFTVPGVQHPVMWYCLT |
| 4058 | EGC1039 | LLCRGQTANNLQPDECLT |
| 4059 | EGC1040 | TCCRDYWMYRFLYTQCGM |
| 4060 | EGC1041 | SFHRCFEWVRHNCVWGA |
| 4061 | EGC1042 | ETLACAKLMPWYNECLARF |
| 4062 | EGC1043 | RYCDHFVNHHDYYKLCLT |
| 4063 | EGC1044 | WQCEWQWVQEWGAWDKFCVM |
| 4064 | EGC1045 | LERLCIEIWSYHCRSFL |
| 4065 | EGC1046 | LATWCQRWLASACFGLF |
| 4066 | EGC1047 | GWCFEYYPEVSRFVYSDCNS |
| 4067 | EGC1049 | YQVKCPFQNPVWWTHCMYLL |
| 4068 | EGC1050 | WHCQWFWVPEWGAWDEFCVM |
| 4069 | EGC1051 | STCLLQYYQFDVFSKKFCPL |
| 4070 | EGC1052 | WHCEWHWVQEWGAWDEFCVM |
| 4071 | EGC1053 | PKVRCPFQNPIWWSHCMEIL |
| 4072 | EGC1056 | SVCHKMWPIIDDLYYCLR |
| 4073 | EGC1057 | SLCQHFQQQPVWYQACIR |
| 4074 | EGC1058 | YQVRCPFQNPVWWSHCMYLL |

TABLE 19-continued

ErbB3 binding MRDs

| SEQ ID: | Ref. No. | Peptide Sequence |
|---|---|---|
| 4075 | EGC1059 | GYCFLFYKFPQYHMQCIS |
| 4076 | EGC1060 | LLCRGQSANNLQRDECLR |
| 4077 | EGC1063 | WHCQWFWVHEWGAWNEFCVM |
| 4078 | EGC1066 | WQCEWEWVQEWGAWDEFCVM |
| 4079 | EGC1070 | DQVKCPFQNPVWWSHCMYLL |
| 4080 | EGC1072 | WHCEWQWVQEWGAWDEFCVM |
| 4081 | EGC1073 | PKVRCPFQNPIWWSIICMKIL |
| 4082 | EGC1074 | GRCRGYEVDPWWHAPCFCDL |
| 4083 | EGC1075 | ILCQHFQQQPVWYQACIR |
| 4084 | EGC1082 | WNEPYCPFLNPTWKAQCIARI |
| 4085 | EGC1083 | LGEPYCPFLNPFWYDQCIARN |
| 4086 | EGC1084 | LGEPYCPFLNPYWYDQCMSRT |
| 4087 | EGC1085 | ASSETYCPFLNPYWYDQCMSR TSGGGSGGGSQAAAGGSYMH EPHMQVLEIMN |

TABLE 20

ErbB4 binding MRDs

| SEQ ID: | Ref. No. | Peptide Sequence |
|---|---|---|
| 4095 | EGD1 | HPWRCLKKPEVVQCLRTG |
| 4096 | EGD2 | GIFACVKEPEVVKCLISW |
| 4097 | EGD3 | HPWRCLEEPEVVQCLRTG |
| 4098 | EGD4 | EERLCYTPEAIFVDCTLHF |
| 4099 | EGD5 | SRADWCDWHKCVVLQW |
| 4100 | EGD6 | AYADWCSWHQCVQLDS |
| 4101 | EGD7 | SVLVCWMYDQCVSVS |
| 4102 | EGD8 | IIRWRCLIEPEVVQCLRTG |
| 4103 | EGD9 | ADGHCWMYYEDWMCLYLM |
| 4104 | EGD10 | SGWHCWVDYFCTRVE |
| 4105 | EGD11 | VGAFCLPFEYWYQDCTRRL |
| 4106 | EGD12 | PVETCMNYYEDIICRFLV |
| 4107 | EGD13 | WKDFCPDVPPWLACTGSS |
| 4108 | EGD14 | FPFSCVMRPHVIECLLSG |
| 4109 | EGD15 | ADGHCWMYYQDWMCLYLM |
| 4110 | EGD16 | EQLNCQEKIQYWCTRIY |
| 4111 | EGD17 | AYADWCSCINASSWT |
| 4112 | EGD18 | AYTDWCSWHRCVQLDS |

TABLE 20-continued

ErbB4 binding MRDs

| SEQ ID: | Ref. No. | Peptide Sequence |
|---|---|---|
| 4113 | EGD19 | YLIMCKEFPWSFTCGTLY |
| 4114 | EGD20 | DNSGCNAPTFVCGFLW |
| 4115 | EGD21 | SPFLCVHDFQVIECLIRW |
| 4116 | EGD22 | QDNCCFIIIDNCQSGF |
| 4117 | EGD23 | SVGRCFSHMPYHVSCSVSV |
| 4118 | EGD24 | GWPPCADWMDQQLCSSAL |
| 4119 | EGD25 | LKYRCVIYFHCYGWM |
| 4120 | EGD26 | SQNVCLHLPWGWECFAWP |
| 4121 | EGD27 | KPWRTCFNHGCELSLR |
| 4122 | EGD28 | SRADWCDWXNASSCS |
| 4123 | EGD29 | EGPPCYDWWTSSCARVR |
| 4124 | EGD30 | ADGHCWMYYEYWMCLYLM |

TABLE 21

DR5binding MRDs

| SEQ ID: | Ref. No. | Peptide Sequence |
|---|---|---|
| 4125 | DR51 | VSDTCMVIMTCRYSP |
| 4126 | DR52 | SERICFKIYMTSKNTCQKAS |
| 4127 | DR54 | ALRPCLVYMSMKCSVTW |
| 4128 | DR55 | SLTPCVYLTMCAPGH |
| 4129 | DR57 | DVGECRVIMTCRPSS |
| 4130 | DR58 | QQGSCKIYMTCRYSH |
| 4131 | DR59 | QWQVCYWTEGRWADSCGWAQ |
| 4132 | DR510 | SVYPCKVIMTCLRSP |
| 4133 | DR512 | TGNTCKRPVLTCNWSG |
| 4134 | DR513 | TEFGCQVYMTCRPKL |
| 4135 | DR514 | SVYPCKVIMTCLKSP |
| 4136 | DR515 | NFRMCIPIMTMHCWADD |
| 4137 | DR516 | DQYTCDRVILTCWTPH |
| 4138 | DR517 | RVSECFLYLTCHKGQ |
| 4139 | DR518 | PTRECTVILTQHCWNVW |
| 4140 | DR519 | LTPCQPIMTCKRPV |
| 4141 | DR520 | SPSPCKVIMTCAPLN |
| 4142 | DR521 | ARHPHEPPYLCMKCL |
| 4143 | DR523 | ANDRCIPIMHWHCWAYW |
| 4144 | DR524 | VQGGCDLVILTCKMWG |
| 4145 | DR525 | LRDFCSTTMAHQCHFGP |

TABLE 21-continued

DR5binding MRDs

| SEQ ID: | Ref. No. | Peptide Sequence |
|---|---|---|
| 4146 | DR526 | AKGECQVYLTCRYNS |
| 4147 | DR527 | GSEGCKVILTMKCPDRI |
| 4148 | DR528 | EYVECGPHQYYWFGHCHFWA |
| 4149 | DR529 | KCNFNPWKAACG |
| 4150 | DR530 | YAERCKVYLTMKCDISQ |
| 4151 | DR531 | PSEMCVVVMRNYCWSST |
| 4152 | DR533 | LSSGCMVYMTMKCGSTK |
| 4153 | DR534 | VGADCWVIMTCRKNL |
| 4154 | DR535 | ATTPCMVYMTCFRTP |
| 4155 | DR537 | QDRACFPIMTLHCPGEG |
| 4156 | DR539 | QTRNCGVWPNHLVCMPLS |
| 4157 | DR540 | LQKVCAAWYYCMESH |
| 4158 | DR541 | LRANCKVVLTERCGNYL |
| 4159 | DR542 | ADEACLVVLTCRASP |
| 4160 | DR543 | SGLGCPQNHLLVLTCRHAM |
| 4161 | DR544 | WIAGCKLVLTERCLNYF |
| 4162 | DR545 | NNSQCQVILTHRCHSLT |
| 4163 | DR548 | KVSVCFPILTMYCSERY |
| 4164 | DR550 | NDLMCQPIMTMKCARYQ |
| 4165 | DR551 | ILIFCQTPPHHCLSKL |
| 4166 | DR552 | SYQRCKVIMTQKCIVPP |
| 4167 | DR553 | TSDRCVVVLTCRMWG |
| 4168 | DR554 | HVSRCEPVLTMHCWRGS |
| 4169 | DR555 | PSYPCSIILTCRSTL |
| 4170 | DR557 | RDSECFIYLTCRVLP |
| 4171 | DR558 | SAEDCFVILTCLCSR |
| 4172 | DR559 | DRYPCYFYLTCIPAS |
| 4173 | DR561 | LQSECFVIMTCKRVN |
| 4174 | DR562 | NTKPCMPIMTCLKWN |
| 4175 | DR563 | WNTPCMVIMTCRPHE |
| 4176 | DR564 | PLTKCKVIMTCARGI |
| 4177 | DR565 | WHYPCQPVLTCRSHN |
| 4178 | DR566 | FQTECLVYMTCRTIY |
| 4179 | DR568 | WESPCFIKLTCHMVA |
| 4180 | DR569 | FVGHCWWPLGLCAPLP |
| 4181 | DR570 | SSMSCVEYQQCRLGY |
| 4182 | DR571 | ARDSCLVYMTCRPVA |

TABLE 21-continued

DR5binding MRDs

| SEQ ID: | Ref. No. | Peptide Sequence |
|---|---|---|
| 4183 | DR573 | LNASCMVYLTQRCSHTS |
| 4184 | DR574 | RIIDGCNKIMLTCIITRA |
| 4185 | DR575 | HRDPCTVVETCRSLS |
| 4186 | DR576 | MTSECQKVILTCWNAS |
| 4187 | DR577 | YMSVCHIDGHQVVCLKNK |
| 4188 | DR580 | SGDTCLVILTHRCATVS |
| 4189 | DR581 | YTAPCKVYMTCVRPM |
| 4190 | DR582 | LRANCKVVLTERCCNYL |
| 4191 | DR583 | PPSSCQVILTCRPIW |
| 4192 | DR584 | LSTRCTDQDIVLTCRIKD |
| 4193 | DR586 | WHYPCQPVLTCRSRT |
| 4194 | DR588 | GQTDCMIIMTCKQWK |
| 4195 | DR589 | PATRCEPVLRHFCWGQG |
| 4196 | DR590 | DSFGCTWEVWGRECHPQL |
| 4197 | DR591 | FYLYCPYPEMSSHCVLRA |
| 4198 | DR592 | LRADCKVVLTERCSNYL |
| 4199 | DR595 | HENPCQVYMTCRHLD |
| 4200 | DR596 | SAEECFVILTCLGSR |
| 4201 | DR597 | ARQDCVPVMRWHCWAEI |
| 4202 | DR598 | PPLGCTRIALTCWDIR |
| 4203 | DR599 | QPPECRVIMTLRCGDAW |
| 4204 | DR5100 | PKQACKIIMTERCWAVD |
| 4205 | DR5101 | TVGECMPIMTCFSTN |
| 4206 | DR5102 | WHYPCQPVLTCRSHT |
| 4207 | DR5104 | PLTKCKVIMTCAWGI |
| 4208 | DR5105 | GISGCKLVLTQRCLHVN |
| 4209 | DR5107 | ERQGCVVYLTERCVVGR |
| 4210 | DR5109 | NNSQCQVILTHHCHSLT |
| 4211 | DR5110 | DKSPCQVVMTCRPLL |
| 4212 | DR5111 | ALHKCMVILTNRCETPV |
| 4213 | DR5112 | TTTSCKLYLTSTCSPNH |
| 4214 | DR5113 | TEYPCKVYMTCMWPI |
| 4215 | DR5114 | LGPNCKIVLTERCGNSL |
| 4216 | DR5115 | SERPCGERPVVMTCFPVR |
| 4217 | DR5116 | GSFSMRWDCGDNPIPGRRQCVIM |
| 4218 | DR5117 | GSAQLLWDCGDNPIMGRRQCVKL |
| 4219 | DR5118 | GSYTHTFDCGDFNITGRRQCVKL |
| 4220 | DR5119 | GSLSSQFDCGENPILGRRQCLYL |
| 4221 | DR5120 | GSRAQIWDCGDNPIRGQRQCVKL |
| 4222 | DR5121 | GSIHIPPRCTEEDVIMTCRRSAD |
| 4223 | DR5122 | GSSTFPRFCAEEDVIMTCRWRFD |
| 4224 | DR5123 | GSNAIPRHCTEEDVIMTCRLRPS |
| 4225 | DR5124 | GSAEFHRPCGEEDVIMTCRWRVH |
| 4226 | DR5125 | GSNALPRACDERDVIMTCRKSVA |
| 4227 | DR5126 | GSYDFPRTCAEEDVIMTCKWRIS |
| 4228 | DR5127 | GSIPSRFDCGENPIAGRRQCVEL |
| 4229 | DR5128 | GSQYIHMDCFENRIRGYCHCIKM |
| 4230 | DR5129 | GSILIPRTCAQEDVIMTCRERAY |
| 4231 | DR5130 | GSQGLPRPCGEEDVIMTCRWSGY |
| 4232 | DR5131 | GSDSFTRTCTEDAVTMTCKWRVL |
| 4233 | DR5132 | GSDPSPRTCAEEDVIMTCRWQVY |
| 4234 | DR5133 | GSSMITRPCAEEDVIMTCKWLPI |
| 4235 | DR5134 | GSGYNPRLCSEQDVIMTCRLRFG |
| 4236 | DR5135 | GSFDRNWDCGDNPIKGRRQCVKV |
| 4237 | DR5136 | GSTYMQFDCGDNPIPGRRQCVPL |
| 4238 | DR5137 | GSFVSHWDCGENPIIGRRQCVLL |
| 4239 | DR5138 | GSPPHSRPCAEEDVIMTCRYRIY |
| 4240 | DR5139 | GSLDRPRPCAEEDVIMTCRWRAA |
| 4241 | DR5140 | GSWKWSPTCAEEDVIMTCRKHVK |
| 4242 | DR5141 | GSKSVPRLCSEEDVIMTCKRGVF |
| 4243 | DR5142 | GSEYWQPPCAEEDVIMTCKWRVV |
| 4244 | DR5143 | GSLCLPRHCAENEVIMTCRPLMF |
| 4245 | DR5144 | GSLMSQWDCGDNPILGRRQCVKL |
| 4246 | DR5145 | GSFKTIWDCGDNPIPGRRMCVKL |
| 4247 | DR5146 | GSSSITWDCGDNPIPGRRQCVIII |
| 4248 | DR5147 | GSPRFKWDCGDNPIAGRRQCVLL |
| 4249 | DR5148 | GSSGFPHHCGEEDVIMTCRWRGL |
| 4250 | DR5149 | GSPHFPRPCAEEDVIMTCRWRVI |
| 4251 | DR5150 | GSGWHTRFCAEEDVIMTCKWRVI |
| 4252 | DR5151 | GSDHWRRSCSEDDVIMTCRWRVS |
| 4253 | DR5152 | GSFKVPHLCAEEDVIMTCRWRVY |
| 4254 | DR5153 | GSRSSPHPCGEEDVIMTCRWRIT |
| 4255 | DR5154 | GSVLQVCDCLDIPVFGTCQCVQL |
| 4256 | DR5155 | GSGDSHWDCGDNPILGRRQCVKL |
| 4257 | DR5156 | GSTSMLWDCGANPIKGRRQCVLL |

TABLE 21-continued

DR5binding MRDs

| SEQ ID: | Ref. No. | Peptide Sequence |
|---|---|---|
| 4258 | DR5157 | GSMPYSWDCGDNPIVGRRQCVKV |
| 4259 | DR5158 | GSFTSRWDCGNNLVIGQRQCIKL |
| 4260 | DR5159 | GSSAPGFDCGDNPIVGQRQCIKL |
| 4261 | DR5160 | GSMVGQRPCAEEDVIMTCRWRVV |
| 4262 | DR5161 | GSSLLPRNCSEEDVIMTCRWRVD |
| 4263 | DR5162 | GSGTTPRRCAEEDVIMTCRWSAH |
| 4264 | DR5163 | GSSYSPRPCAEEDVIMTCRPRFH |
| 4265 | DR5164 | GSGVFPRPCHEEDVIMTCRWRVH |
| 4266 | DR5165 | GSADPLWDCGDNPIKGRRQCVPL |
| 4267 | DR5166 | GSLPHAWDCGDNPIPGRRQCVKL |
| 4268 | DR5167 | GSTKLTHPCGEEDVIMTCRWRVA |
| 4269 | DR5168 | GSTASPRHCAEHDVIMTCRWPVD |
| 4270 | DR5169 | GSERLARSCDEDDVIMTCRWRVT |
| 4271 | DR5170 | GSNKPPRPCSEEDVIMTCRWRVV |
| 4272 | DR5171 | QGSDEWDCLDNRIGRRQCVKL |
| 4273 | DR5172 | GSSLSSWDCGDNPIPGRRQCVKL |
| 4274 | DR5173 | GSPSEYWDCGDNPIFGRRQCVRL |
| 4275 | DR5174 | GSLSPLWDCGDNPILGRRQCVLL |
| 4276 | DR5175 | GSAAHYWDCGDNPIVGRRQCVKL |
| 4277 | DR5176 | GSYLYPRPCSEEDVIMTCRWRVS |
| 4278 | DR5177 | GSSSFTPTCNEEDVIMTCRWRVV |
| 4279 | DR5178 | GSLSAPPTCAEEDVIMTCRWRLK |
| 4280 | DR5179 | GSRNFPVPCDESDVIMTCKWRVS |
| 4281 | DR5180 | GSDRFQRHCSEADVIMTCKSRLY |
| 4282 | DR5181 | QGSDEWDCLDNRIGKRQCVKL |
| 4283 | DR5183 | GSSSFPRPCAEEDVIMTCKWRVY |
| 4284 | DR5184 | GSMLLPRSCAEEDVIMTCRWAHY |
| 4285 | DR5185 | GSGKCTEEDVIMTCRSKVT |
| 4286 | DR5186 | GSSHFPHPCSEEDVIMTCRWRVN |
| 4287 | DR5187 | GSVDFPRPCLEDDVIMTCKWRLY |
| 4288 | DR5189 | GSVLDILSCKCLDTSSHVQCVTL |
| 4289 | DR5190 | GSRMSSPSFDCKGDFGHRQCVKL |
| 4290 | DR5191 | GSGEPSDGRVCLTKCSSLIQCFKF |
| 4291 | DR5192 | GSHCLYVVWECVDHGICLRRCAEL |
| 4292 | DR5193 | GSNNTTSMWDCLDRPIGQRQCVKL |
| 4293 | DR5194 | GSYWSFSKWDCLDRPLGQRQCVLL |
| 4294 | DR5195 | GSPTVPNQCHCQDNRISRMCVIL |
| 4295 | DR5196 | GSDKFRERWDCLDYRIGHRQCIKL |
| 4296 | DR5197 | GSMYTDDDRVCLTTCSVLRQCIKL |
| 4297 | DR5198 | GSDLFSSRWDCLGKLGQRQCVKL |
| 4298 | DR5199 | GSQLLTFGWDCLDRPIGQRQCVKI |
| 4299 | DR5200 | GSGDEHAYWDCLDRPIGQRQCVKM |
| 4300 | DR5201 | GSSGFYERWDCLDHHIGRRQCVKL |
| 4301 | DR5203 | GSMKVTGPWDCLDRPIGQRQCVYL |
| 4302 | DR5204 | GSLPDTYLTNCIHNRHDLCLCSKII |
| 4303 | DR5205 | GSRSSSMPSVCLTDCISLRQCVKL |
| 4304 | DR5206 | GSSNSMEPRVCLTNCTALRMCAKL |
| 4305 | DR5207 | GSRIDLSQWDCLDYRLGQRQCVKV |
| 4306 | DR5209 | GSIGHSPRWDCVGKPGHRQCVKL |
| 4307 | DR5210 | GSQLLTSMFDCGDRPMGRRQCVLV |
| 4308 | DR5211 | GSPHPTATRVCLTDCLSLRKCLKM |
| 4309 | DR5212 | GSCTGVLTQACPAQNSFLQCVEL |
| 4310 | DR5213 | GSSNFESRWDCIGNVGSRQCVKL |
| 4311 | DR5214 | GSHNHYDDQVCLTQCNNLRLCIEL |
| 4312 | DR5215 | GSQAPNIESLCLTRCVNLLHCIKI |
| 4313 | DR5216 | WDCLDRPLGQRQCVLL |
| 4314 | DR5217 | FDCKGDFGHRQCVKL |
| 4315 | DR5219 | WDCLDRPIGQRQCVKM |
| 4316 | DR5220 | WDCLDYRLGQRQCVKV |
| 4317 | DR5221 | WDCLDRPIGQRQCVYL |
| 4318 | DR5222 | WDCVGKPGHRQCVKL |
| 4319 | DR5223 | WDCLDYRIGHRQCIKL |
| 4320 | DR5224 | WDCIGNVGSRQCVKL |

TABLE 22

CD3 binding MRDs

| SEQ ID: | Ref. No. | Peptide Sequence |
|---|---|---|
| 4329 | CD32 | FDLLCVHVESHKYYCFRPI |
| 4330 | CD34 | FILSCHWHNGVVRCYEVS |
| 4331 | CD38 | PPFSCVFDVPTWSWVCGQKS |
| 4332 | CD311 | AQLLCIIIIVTGKYFSCREVI |
| 4333 | CD317 | DWWLCESEKQTFWCSILR |
| 4334 | CD318 | RGMQCHFEKTGWMWVCSLAG |
| 4335 | CD323 | FMMQCQYVMNGIYCYDSG |

TABLE 22-continued

CD3 binding MRDs

| SEQ ID: | Ref. No. | Peptide Sequence |
|---|---|---|
| 4336 | CD324 | FRLGCVPLPVIQACVAQAAAGGSKIWECEQNPQVWICNLTS |
| 4337 | CD326 | PKLLCHDTEDIYCFCELLK |
| 4338 | CD328 | LFGRCYLYHNLAWYHCVLVW |
| 4339 | CD329 | IGLLCKKDHGEWSCFRIY |
| 4340 | CD330 | FMVDCQKMPHYIICAERG |
| 4341 | CD331 | EWQCAYYPQYFQWQCEILG |
| 4342 | CD332 | GPPWCMWHQRQYSWICIFGE |
| 4343 | CD335 | IAWDCQWHHQWHAWECTMNS |
| 4344 | CD337 | WDAVLCVNKRCSGLYF |
| 4345 | CD338 | TVVRCYQSPYVYWICKFPT |
| 4346 | CD340 | FSVICWQKPDYLYCAEDA |
| 4347 | CD341 | RTVYCGWDANRQAWLCHCQN |
| 4348 | CD342 | PGFRCSWWEIAKSWVCTMPV |
| 4349 | CD343 | DLLDCSFNEFEWHWTCSFTQ |
| 4350 | CD345 | PLVSCQYFPPLHHWRCDFLV |
| 4351 | CD347 | DKWKCRWKEAYICMRDS |
| 4352 | CD348 | YRLSCQYLSAHQVICSGLW |
| 4353 | CD349 | RWAYCSVQDIMWDCTLFP |
| 4354 | CD354 | TMITCHWRKDHYDWMCQLEY |
| 4355 | CD356 | FILSCHWNLGVVPCYEVS |
| 4356 | CD357 | PVMSCEPIPIGWKCSLQT |
| 4357 | CD360 | FSPECHYFPGYWKCTWSL |
| 4358 | CD361 | WPQRCVWWWEMDYKCRSLI |
| 4359 | CD365 | TYWDCVVGHKHMQCLRLS |
| 4360 | CD367 | SRGWCQYEYQHSQWRCFIHE |
| 4361 | CD368 | RLVSCSWENSKWQWTCSVLE |
| 4362 | CD369 | PDSSCHTLYWQLHHCARRE |
| 4363 | CD370 | GQVTCNYNPATHSWVCSCIS |
| 4364 | CD3309 | TVFRCVFVNEYRVWFCHIST |
| 4365 | CD3318 | GEEVCYWAPFEPVRCLPVW |
| 4366 | CD3323 | VFMVCVHHYEKVKCWAFW |
| 4367 | CD3324 | FFALCKFQNFHTATCLKLI |
| 4368 | CD3354 | WSFLCIKVTQQHYECFLFS |
| 4369 | CD3364 | GLVSCVILPQGWFCFKTA |
| 4370 | CD3366 | QVKYCVVTHMMCVIDL |
| 4371 | CD3399 | RSALCHDKMTVKSYCLSSR |
| 4372 | CD3412 | IFFVCPNNQYDCAVNH |
| 4373 | CD3430 | WNFFCITFGPYLHCWIYT |
| 4374 | CD3431 | TMEVCYWGPFTTATCERWP |
| 4375 | CD3432 | WECYCQGIIVIIYEYCVCFR |
| 4376 | CD3433 | NHWFCFTDWHHFVCFKFA |
| 4377 | CD3435 | CWVSCWIWPNMWYCWLDC |
| 4378 | CD3436 | GVGGLLLGSVRTGSLPPGVGPG |
| 4379 | CD3438 | YAAWCFKLNKLEVTCFSGI |
| 4380 | CD3439 | ARFVCFSLVEAQWYCLVLS |
| 4381 | CD3440 | IYFTCVWYAQQFWCIVMP |
| 4382 | CD3444 | RGWVCYFPPHFVCYTWV |
| 4383 | CD3446 | FSLVCIQMYNQVYCVFIL |
| 4384 | CD3447 | QDFLCVKIEPFPWICWTMQ |
| 4385 | CD3448 | FTCVCYQHYDHFWCGCLW |
| 4386 | CD3449 | ILWACVKQYDGMICWSPS |
| 4387 | CD3450 | FWLLCIHAPKQDVCFIWM |
| 4388 | CD3453 | FRALCWEHPPTRYCILFT |
| 4389 | CD3454 | TAWWCVIMPPKFFCASFN |
| 4390 | CD3455 | GRVSCYWETHLNVVCVPSL |
| 4391 | CD3457 | IKLECKVIIAPSMLSCTLWQ |
| 4392 | CD3458 | YEWSCLITPYGHWCAQTV |
| 4393 | CD3459 | FTLLCIKFELKPYICWVSL |
| 4394 | CD3461 | TPRGCTFIFIMPDMCRPSL |
| 4395 | CD3462 | LRCTCWIFPKNVYCLCLS |
| 4396 | CD3463 | AFLLRCYAQECVILWL |
| 4397 | CD3465 | GMVSCVIMPQGWFCFKTA |
| 4398 | CD3466 | MHWVCIIFPPGFFCVSTF |
| 4399 | CD3470 | LHFRCFQLYNEYWVCIMSV |
| 4400 | CD3474 | WNFLCFFTHHKPVWYCVWTM |
| 4401 | CD3475 | GFQCWCPHVVCFRVPY |
| 4402 | CD3477 | MQFLCLTVQTNTWYCFLWL |
| 4403 | CD3478 | FIVRCVIGQKLVCVQTE |
| 4404 | CD3479 | WSPNCLWFIKTTYVVCPDST |
| 4405 | CD3480 | YAWECQWIVKPHQFVCGGM |
| 4406 | CD3481 | GTLRCYSLNWGYFCILFV |
| 4407 | CD3482 | NKVECHIVLWTFHFGCPSAT |
| 4408 | CD3483 | TSMVCRSMHMYWLCVNLD |
| 4409 | CD3487 | NRVLCMMNYIHVTKLCDRPM |
| 4410 | CD3490 | PLMLCRHMKHFQYYCWPLA |

TABLE 22-continued

CD3 binding MRDs

| SEQ ID: | Ref. No. | Peptide Sequence |
|---|---|---|
| 4411 | CD3491 | PSQRCVNHFVTFFNCTQSN |
| 4412 | CD3492 | WNFFCITFSPTCIVDLYWPG |
| 4413 | CD3493 | WTMRCYSHAPNKLVCSVGL |
| 4414 | CD3494 | LVLHCDYQQGVWTCKAVL |
| 4415 | CD3495 | VMFVCFSLPEQQVCVPLS |
| 4416 | CD3689 | PVQICQWTLELQCSPWT |
| 4417 | CD3690 | LQWVCHWVAECSMSP |
| 4418 | CD3693 | RGFICEWNLVASCVPAT |
| 4419 | CD3694 | RIWICDWTIECVESL |
| 4420 | CD3697 | FVCECFAWDWFGPWQCMCSV |
| 4421 | CD3700 | RFWIECWTEACRPGLLGQAGQGGPGSAGGSYPSIECYSYMCNVLWF |
| 4422 | CD3703 | LRSSCEYHQTCNQSSQAAAGGSREMKCDWRVDCLYYV |
| 4423 | CD3704 | TLTVCQWVLHATCVDVQ |
| 4424 | CD3706 | VSIRCHQYLLCVFES |
| 4425 | CD3707 | SAWFCEWTFQCQLMG |
| 4426 | CD3708 | GFIVCYWEAVCQSST |
| 4427 | CD3709 | VLWRCTWVMECVSVS |
| 4428 | CD3718 | DMWLCHWRIECVPYL |
| 4429 | CD3724 | PWASCYFYQEHVHCEPPD |
| 4430 | CD3743 | SYSVCEWEFVYSCWPPY |
| 4431 | CD3789 | RQQPCLKIWSCLQLY |
| 4432 | CD3793 | PVQICQWTLELPCSPWT |
| 4433 | CD3832 | PVPICPWTLELHCPPWTGHA |
| 4434 | CD3872 | MACLCVSWSKCTPLG |
| 4435 | CD3882 | QTMKCPMEMGHCTTWR |
| 4436 | CD3912 | FILLCIIQYLVCIKQE |
| 4437 | CD3919 | FYMRDCESHRCRLDLS |
| 4438 | CD3924 | GFQLACRFMSCGCRSC |
| 4439 | CD3935 | PLMLCRHMKHFEYYCWPL |
| 4440 | CD3940 | QDFLCVKIEPFPWICWTMGQ |
| 4441 | CD3942 | IYFYCVEWYQKWICYTVV |
| 4442 | CD3952 | VTCFYVETDHVVCFREA |
| 4443 | CD3959 | GRVSCYWETHLNVVCVPSL |
| 4444 | CD3960 | FPCVCIMTHHHLECFCFIGQ |
| 4445 | CD3972 | FSLVCIQMYNQVYCVFILGQ |
| 4446 | CD3981 | ILWACVKQYDGMICWSPSGQ |
| 4447 | CD3992 | VKLPCFLIQEMGWMCFWPL |
| 4448 | CD3998 | WNFFCINFSPYLHCWIYTGQ |
| 4449 | CD31008 | MYVLCKEAQVGQQWKCVQFF |
| 4450 | CD31014 | YTPECGWGYMIMFKHCRHYE |
| 4451 | CD31025 | FWLLCLHVWNKTTVYCLVKH |
| 4452 | CD31032 | FQCVCHWNDGRVVCLCHY |
| 4453 | CD31034 | DYTSCQFRGWLICEAMA |
| 4454 | CD31035 | LVMLCWKWHEVRHCLLLS |
| 4455 | CD31039 | VVLTCSSSWERSVFVCRLVE |
| 4456 | CD31045 | LAFLCIHWQEHLWCIVRP |
| 4457 | CD31047 | SVVTCYIIMFPWDRIICFLQ |
| 4458 | CD31051 | TVRCWCEHMVCFMERD |
| 4459 | CD31054 | CHFLCFKLGFMEYFYCEYSC |
| 4460 | CD31058 | VMLACYKHPLNNSEWCYILP |
| 4461 | CD31063 | FRVLCADVPGHRYCFIVS |
| 4462 | CD31068 | LVFRCLHITQHWFCFGLT |
| 4463 | CD31077 | EYDSCMFYGFIICPKQT |
| 4464 | CD31079 | MLFVRCEHGRCTVYEI |
| 4465 | CD31086 | CEIFCMVSLETQKMVCVIIRA |
| 4466 | CD31120 | MGFLCWSQPGNEYEWCVPIN |
| 4467 | CD31138 | RFIHCVHFEWINHIVCFVGT |
| 4468 | CD31162 | QDFLCVKIEPFPWICWTMQ |
| 4469 | CD31165 | DRALCWLHPHFATVQCIIMS |
| 4470 | CD31173 | VTCFYVETDHVVCFREA |
| 4471 | CD31179 | GRVSCYWETHLNVVCVPSL |
| 4472 | CD31180 | FPCVCIMTHHHLECFCFI |
| 4473 | CD31190 | FSLVCIQMYNQVYCVFIL |
| 4474 | CD31199 | ILWACVKQYDGMICWSPS |
| 4475 | CD31211 | ADSWCHTLYWNLRHCEIQE |
| 4476 | CD31217 | WNFFCINFSPYLIICWIYT |
| 4477 | CD31249 | ESLDCATPLLLCTGCGDQA |
| 4478 | CD31254 | SFQMCMGWFWWCWSHS |
| 4479 | CD31255 | WSQSGCTYAHCMYCIH |
| 4480 | CD31420 | VNCWLHLQFFYSEQYCIE |
| 4481 | CD31567 | ATGGSLVVKCDWWLDCLVYL |
| 4482 | CD31579 | DLQICHWTLELECSPRK |
| 4483 | CD31605 | ATGGSREIRCKWRVDCMCYS |

TABLE 22-continued

CD3 binding MRDs

| SEQ ID: | Ref. No. | Peptide Sequence |
|---|---|---|
| 4484 | CD31631 | SLSSCELYYKCRHFSQAGQGSATGGSLVVKCDWWLDCLVYL |
| 4485 | CD31644 | LRCFCDYYQTCKQYTVAGQGSATGGSREIRCKWRVDCMCYS |
| 4486 | CD31656 | WNYFCVYFSPYLIICWIYS |
| 4487 | CD31663 | WNFVCIFVSPYMHCWLYF |
| 4488 | CD31697 | WKFLCESTLSPYLHCWIYP |
| 4489 | CD31718 | WNFFCIYISPHVHCWIHS |
| 4490 | CD31727 | TAWDCVVGQKYMLCQRLS |
| 4491 | CD31803 | CQERCGKMIKSIVMQCNLRL |

TABLE 22-continued

CD3 binding MRDs

| SEQ ID: | Ref. No. | Peptide Sequence |
|---|---|---|
| 4492 | CD31909 | SVSVCVEHAYGQWYCFAAR |
| 4493 | CD31915 | TMKCPMEMGHCTTWR |

Although the invention has been described with reference to the above examples, it will be understood that modifications and variations are encompassed within the spirit and scope of the invention. Accordingly, the invention is limited only by the following claims All publications, patents, patent applications, internet sites, and accession numbers/database sequences (including both polynucleotide and polypeptide sequences) cited are herein incorporated by reference in their entirety for all purposes to the same extent as if each individual publication, patent, patent application, internet site, or accession number/database sequence were specifically and individually indicated to be so incorporated by reference.

SEQUENCE LISTING (4520 sequences)

SEQ ID NO: 1 - protein, 4 aa, Artificial sequence
  short linker peptide
GGGS

SEQ ID NO: 2 - protein, 15 aa, Artificial sequence
  medium linker peptide
SSGGGGSGGGGGGSS

SEQ ID NO: 3 - protein, 7 aa, Artificial sequence
  integrin targeting MRD
YCRGDCT

SEQ ID NO: 4 - protein, 7 aa, Artificial sequence
  integrin targeting MRD
PCRGDCL

SEQ ID NO: 5 - protein, 7 aa, Artificial sequence
  integrin targeting MRD
TCRGDCY

SEQ ID NO: 6 - protein, 7 aa, Artificial sequence
  integrin targeting MRD
LCRGDCF

SEQ ID NO: 7 - protein, 28 aa, Artificial sequence
  angiogenic cytokine targeting MRD
MGAQTNFMPMDDLEQRLYEQFILQQGLE

SEQ ID NO: 8 - protein, 28 aa, Artificial sequence
  lm32 MRD
MGAQTNFMPMDNDELLLYEQFILQQGLE

SEQ ID NO: 9 - protein, 27 aa, Artificial sequence
  ANGa
GAQTNFMPMDDLEQRLYEQFILQQGLE

SEQ ID NO: 10 - protein, 54 aa, Artificial sequence
  2xCon4 peptide
AQQEECEWDPWTCEHMGSGSATGGSGSTASSGSGSATHQEECEWDPWTCEHMLE

SEQ ID NO: 11 - protein, 18 aa, Artificial sequence
  ANGb
LWDDCYFFPNPPHCYNSP

SEQ ID NO: 12 - protein, 18 aa, Artificial sequence
  ANGc
LWDDCYSYPNPPHCYNSP

SEQ ID NO: 13 - protein, 19 aa, Artificial sequence
  VEGF targeting MRD
VEPNCDIHVMWEWECFERL

SEQ ID NO: 14 - protein, 27 aa, Artificial sequence
  IGF1R
SFYSCLESLVNGPAEKSRGQWDGCRKK

SEQ ID NO: 15 - protein, 18 aa, Artificial sequence
  ANGd
LWDDCYSFPNPPHCYNSP

SEQ ID NO: 16 - protein, 18 aa, Artificial sequence
  ANGe
DCAVYPNPPWCYKMEFGK

SEQ ID NO: 17 - protein, 18 aa, Artificial sequence
  ANGf
PHEECYFYPNPPHCYTMS

SEQ ID NO: 18 - protein, 18 aa, Artificial sequence
  ANGg
PHEECYSYPNPPHCYTMS

SEQ ID NO: 19 - protein, 18 aa, Artificial sequence
  long linker peptide
SSGGGGSGGGGGGSSRSS

SEQ ID NO: 20 - protein, 60 aa, Artificial sequence
  LM-2x-32
MGAQTNFMPMDNDELLLYEQFILQQGLEGGSGSTASSGSGSSLGAQTNFMPMDNDELLLY

SEQ ID NO: 21 - protein, 26 aa, Artificial sequence
  fusion protein linker
GYYVCYPRGSKPEDANFYLYLRARVC

SEQ ID NO: 22 - protein, 7 aa, Artificial sequence
  fusion protein linker
YLYLRAR

SEQ ID NO: 23 - protein, 23 aa, Artificial sequence
  fusion protein linker
YRCNGTDIYKDKESTVQVHYRMC

SEQ ID NO: 24 - protein, 9 aa, Artificial sequence
  fusion protein linker
DKESTVQVH

SEQ ID NO: 25 - protein, 78 aa, Artificial sequence
  human CD3 delta mature ECD
KIPIEELEDRVFVNCNTSITWVEGTVGTLLSDITRLDLGKRILDPRGIYRCNGTDIYKDKESTVQVHYRMCQSCVELD

SEQ ID NO: 26 - protein, 89 aa, Artificial sequence
  human CD3 gamma mature ECD
QSIKGNHLVKVYDYQEDGSVLLTCDAEAKNITWFKDGKMIGFLTEDKKKWNLGSNAKDPRGMYQCKGSQNKSKPLQVYYRMCQNCIELN

SEQ ID NO: 27 - protein, 105 aa, Artificial sequence
  human CD3 epsilon mature ECD
GNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVM

SEQ ID NO: 28 - protein, 9 aa, Artificial sequence
  human CD3 zeta mature ECD
QSFGLLDPK

SEQ ID NO: 29 - protein, 27 aa, Artificial sequence
  multivalent and monovalent multispecific composition binder
QDGNEEMGGITQTPYKVSISGTTVILT

SEQ ID NO: 30 - protein, 10 aa, Artificial sequence
  multivalent and monovalent multispecific composition binder
QDGNEEMGGI

SEQ ID NO: 31 - protein, 9 aa, Artificial sequence
  multivalent and monovalent multispecific composition binder
QDGNEEMGG

SEQ ID NO: 32 - protein, 35 aa, Artificial sequence
  MRD expressed as a MBP fusion protein
KSLSLSPGSGGGSMGAQTNFMPMDNDELLLYEQFI

SEQ ID NO: 33 - protein, 35 aa, Artificial sequence
  MRD expressed as a MBP fusion protein
KSLSLSPGSGGGSMGAQTNFMPMDNEELLLYEQFI

SEQ ID NO: 34 - protein, 41 aa, Artificial sequence
  HER-lm32(H) Construct
KSLSLSPGKGGGSMGAQTNFMPMDNDELLLYEQFILQQGLE

SEQ ID NO: 35 - protein, 28 aa, Artificial sequence
  Rm4-31 Mutant
NFYQCIEMLASHPAEKSRGQWQECRTGG

SEQ ID NO: 36 - protein, 28 aa, Artificial sequence
  Rm4-33 Mutant
NFYQCIEQLALRPAEKSRGQWQECRTGG

SEQ ID NO: 37 - protein, 28 aa, Artificial sequence
  Rm4-39 Mutant
NFYQCIDLLMAYPAEKSRGQWQECRTGG

SEQ ID NO: 38 - protein, 28 aa, Artificial sequence
  Rm4-310 Mutant
NFYQCIERLVTGPAEKSRGQWQECRTGG

SEQ ID NO: 39 - protein, 28 aa, Artificial sequence
  Rm4-314 Mutant
NFYQCIEYLAMKPAEKSRGQWQECRTGG

SEQ ID NO: 40 - protein, 28 aa, Artificial sequence
  Rm4-316 Mutant
NFYQCIEALQSRPAEKSRGQWQECRTGG

SEQ ID NO: 41 - protein, 28 aa, Artificial sequence
  Rm4-319 Mutant
NFYQCIEALSRSPAEKSRGQWQECRTGG

SEQ ID NO: 42 - protein, 27 aa, Artificial sequence
  Rm4-44 Mutant
NFYQCIEHLSGSPAEKSRGQWQECRTG

SEQ ID NO: 43 - protein, 27 aa, Artificial sequence
  Rm4-45 Mutant
NFYQCIESLAGGPAEKSRGQWQECRTG

SEQ ID NO: 44 - protein, 27 aa, Artificial sequence
  Rm4-46 Mutant
NFYQCIEALVGVPAEKSRGQWQECRTG

SEQ ID NO: 45 - protein, 27 aa, Artificial sequence
  Rm4-49 Mutant
NFYQCIEMLSLPPAEKSRGQWQECRTG

SEQ ID NO: 46 - protein, 27 aa, Artificial sequence
  Rm4-410 Mutant
NFYQCIEVFWGRPAEKSRGQWQECRTG

SEQ ID NO: 47 - protein, 27 aa, Artificial sequence
  Rm4-411 Mutant
NFYQCIEQLSSGPAEKSRGQWQECRTG

SEQ ID NO: 48 - protein, 27 aa, Artificial sequence
  Rm4-415 Mutant
NFYQCIELLSARPAEKSRGQWAECRAG

SEQ ID NO: 49 - protein, 27 aa, Artificial sequence
  Rm4-417 Mutant
NFYQCIEALARTPAEKSRGQWVECRAP

SEQ ID NO: 50 - DNA, 18 bp, Artificial sequence
  Rm2-2-218
gtggagtgcagggcgccg

SEQ ID NO: 51 - protein, 6 aa, Artificial sequence
  Rm2-2-218
VECRAP

SEQ ID NO: 52 - DNA, 18 bp, Artificial sequence
  Rm2-2-316
gctgagtgcagggctggg

SEQ ID NO: 53 - protein, 6 aa, Artificial sequence
  Rm2-2-316
AECRAG

SEQ ID NO: 54 - DNA, 18 bp, Artificial sequence
  Rm2-2-319
caggagtgcaggacgggg

SEQ ID NO: 55 - protein, 6 aa, Artificial sequence
  Rm2-2-319
QECRTG

SEQ ID NO: 56 - protein, 41 aa, Artificial sequence
  HER-mpm(H)
KSLSLSPGSGGGSGGAQTNFMPMDQDEALLYEEFILQQGLE

SEQ ID NO: 57 - protein, 41 aa, Artificial sequence
  HER-lm32 (MPM Q8C G30C) (H)
KSLSLSPGSGGGSGGACTNFMPMDQDEALLYEEFILQQCLE

SEQ ID NO: 58 - protein, 41 aa, Artificial sequence
  HER-lm32 (MPM T9C G30C) (H)
KSLSLSPGSGGGSGGAQCNFMPMDQDEALLYEEFILQQCLE

SEQ ID NO: 59 - protein, 12 aa, Artificial sequence
  trastuzumab VL-CDR1
RASQDVNTAVAW

SEQ ID NO: 60 - protein, 7 aa, Artificial sequence
  trastuzumab VL-CDR2
SASFLYS

SEQ ID NO: 61 - protein, 9 aa, Artificial sequence
  trastuzumab VL-CDR3
QQHYTTPPT

SEQ ID NO: 62 - protein, 10 aa, Artificial sequence
  trastuzumab VH-CDR1
GRNIKDTYIH

SEQ ID NO: 63 - protein, 17 aa, Artificial sequence
  trastuzumab VH-CDR2
RIYPTNGYTRYADSVKG

SEQ ID NO: 64 - protein, 11 aa, Artificial sequence
  trastuzumab VH-CDR3
WGGDGFYAMDY

SEQ ID NO: 65 - protein, 109 aa, Artificial sequence
  trastuzumab VL
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 66 - protein, 120 aa, Artificial sequence [sequence omitted]

SEQ ID NO: 67 - protein, 41 aa, Artificial sequence
  HER-lm32 (MPM N10C G30C) (H) Construct
KSLSLSPGSGGGSGGAQTCFMPMDQDEALLYEEFILQQCLE

SEQ ID NO: 68 - protein, 41 aa, Artificial sequence
  HER-lm32 (MPM F11C G30C) (H) Constructs
KSLSLSPGSGGGSGGAQTNCMPMDQDEALLYEEFILQQCLE

SEQ ID NO: 69 - protein, 41 aa, Artificial sequence
  HER-lm32 (MPM N10C  L28C) (H) Construct
KSLSLSPGSGGGSGGAQTCFMPMDQDEALLYEEFICQQGLE

SEQ ID NO: 70 - protein, 41 aa, Artificial sequence
  HER-lm32 (MPM M5C G30C) (H) Construct
KSLSLSPGSGGGSCGAQTNFMPMDQDEALLYEEFILQQCLE

SEQ ID NO: 71 - protein, 7 aa, Artificial sequence
  antibody-MRD fusion MRD
ATWLPPP

SEQ ID NO: 72 - protein, 11 aa, Artificial sequence
  bevacizumab VL-CDR1
SASQDISNYLN

SEQ ID NO: 73 - protein, 7 aa, Artificial sequence
  bevacizumab VL-CDR2
FTSSLHS

SEQ ID NO: 74 - protein, 9 aa, Artificial sequence
  bevacizumab VL-CDR3
QQYSTVPWT

SEQ ID NO: 75 - protein, 10 aa, Artificial sequence
  bevacizumab VH-CDR1
GYTFTNYGMN

SEQ ID NO: 76 - protein, 17 aa, Artificial sequence
  bevacizumab VH-CDR2
WINTYTGEPTYAADFKR

SEQ ID NO: 77 - protein, 14 aa, Artificial sequence
  bevacizumab VH-CDR3
YPHYYGSSHWYFDV

SEQ ID NO: 78 - protein, 108 aa, Artificial sequence
  bevacizumab VL
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 79 - protein, 123 aa, Artificial sequence [sequence omitted]

SEQ ID NO: 80 - protein, 11 aa, Artificial sequence
  adalimumab VL-CDR1
RASQGIRNYLA

SEQ ID NO: 81 - protein, 7 aa, Artificial sequence
  adalimumab VL-CDR2
AASTLQS

SEQ ID NO: 82 - protein, 9 aa, Artificial sequence
  adalimumab VL-CDR3
QRYNRAPYT

SEQ ID NO: 83 - protein, 5 aa, Artificial sequence
  adalimumab VH-CDR1
DYAMH

SEQ ID NO: 84 - protein, 17 aa, Artificial sequence
  adalimumab VH-CDR2
AITWNSGHIDYADSVEG

SEQ ID NO: 85 - protein, 12 aa, Artificial sequence
  adalimumab VH-CDR3
VSYLSTASSLDY

SEQ ID NO: 86 - protein, 108 aa, Artificial sequence
  adalimumab VL
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 87 - protein, 121 aa, Artificial sequence [sequence omitted]

SEQ ID NO: 88 - protein, 41 aa, Artificial sequence
  MRD expressed as a MBP fusion protein
KSLSLSPGSGGGSMGAQTNFMPMDNDEGLLYEQFILQQGLE

SEQ ID NO: 89 - protein, 41 aa, Artificial sequence
  MRD expressed as a MBP fusion protein
KSLSLSPGSGGGSMGAQTNFMPMDNDELGLYEQFILQQGLE

SEQ ID NO: 90 - protein, 41 aa, Artificial sequence
  MRD expressed as a MBP fusion protein
KSLSLSPGSGGGSMGAQTNFMPMDNDEALLYEQFILQQGLE

SEQ ID NO: 91 - protein, 41 aa, Artificial sequence
  MRD expressed as a MBP fusion protein
KSLSLSPGSGGGSMGAQTNFMPMDNDELTLYEQFILQQGLE

SEQ ID NO: 92 - protein, 41 aa, Artificial sequence
  MRD expressed as a MBP fusion protein
KSLSLSPGSGGGSMGAQTNFMPMDNDELLLYEQFIYQQGLE

SEQ ID NO: 93 - protein, 41 aa, Artificial sequence
  MRD expressed as a MBP fusion protein
KSLSLSPGSGGGSMGAQTNFMPMDNDEGLLYEQFIYQQGLE

SEQ ID NO: 94 - protein, 41 aa, Artificial sequence
  MRD expressed as a MBP fusion protein
KSLSLSPGSGGGSMGAQTNFMPMDNDEALLYEQFIYQQGLE

SEQ ID NO: 95 - protein, 39 aa, Artificial sequence
  MRD expressed as a MBP fusion protein
KSLSLSPGSGGGSMGAQTNFMPMDNEELTLYEQFIFQQG

SEQ ID NO: 96 - protein, 41 aa, Artificial sequence
  MRD expressed as a MBP fusion protein
KSLSLSPGSGGGSMGAQTNFMPMDNDEGLLYEEFILQQGLE

SEQ ID NO: 97 - protein, 41 aa, Artificial sequence
  MRD expressed as a MBP fusion protein
KSLSLSPGSGGGSMGAQTNFMPMDNDEALLYEEFILQQGLE

SEQ ID NO: 98 - protein, 41 aa, Artificial sequence
  MRD expressed as a MBP fusion protein
KSLSLSPGSGGGSMGAQTNFMPMDNEELTLYEEFILQQGLE

SEQ ID NO: 99 - protein, 41 aa, Artificial sequence
  MRD expressed as a MBP fusion protein
KSLSLSPGSGGGSMGAQTNFMPMDQDELLLYEQFILQQGLE

SEQ ID NO: 100 - protein, 41 aa, Artificial sequence
  MRD expressed as a MBP fusion protein
KSLSLSPGSGGGSMGAQTNFMPMDDDELLLYEQFILQQGLE

SEQ ID NO: 101 - protein, 41 aa, Artificial sequence
  HER-lm32 (MPM M5C L28C) (H) Construct
KSLSLSPGSGGGSCGAQTNFMPMDQDEALLYEEFICQQGLE

SEQ ID NO: 102 - protein, 105 aa, Artificial sequence
  MRD light chain constant region inserter
RTVAAPSVFIFPPSDEQLKSGTASVVCLLNNFYPREAKVQWKVDKLGTNSQESVTEQDSKDSTYSLSSTLTLSKADYEKHKVYACEVTHQGLSLPVTKSFNRGEC

SEQ ID NO: 103 - protein, 10 aa, Artificial sequence
  antibody that binds ErbB2 linked to MRD linker
SLFVPRPERK

SEQ ID NO: 104 - protein, 10 aa, Artificial sequence
  antibody that binds ErbB2 linked to MRD linker
ESDVLHFTST

SEQ ID NO: 105 - protein, 9 aa, Artificial sequence
  antibody that binds ErbB2 linked to MRD linker
LRKYADGTL

SEQ ID NO: 106 - protein, 9 aa, Artificial sequence
  MRD that targets integrin RGD4C linker
CDCRGDCFC

SEQ ID NO: 107 - protein, 28 aa, Artificial sequence
  L17D
MGAQTNFMPMDDDELLLYEQFILQQGLE

SEQ ID NO: 108 - protein, 41 aa, Artificial sequence
  HER-lm32 MPM A7C G30C) (H) Constructs
KSLSLSPGSGGGSGGCQTNFMPMDQDEALLYEEFILQQCLE

SEQ ID NO: 109 - protein, 41 aa, Artificial sequence
  HER-lm32 (MPM P13C G30C) (H)
KSLSLSPGSGGGSGGAQTNFMCMDQDEALLYEEFILQQCLE

SEQ ID NO: 110 - protein, 41 aa, Artificial sequence
  HER-lm32 (MPM M5C N10C) (H) Constructs
KSLSLSPGSGGGSCGAQTCFMPMDQDEALLYEEFILQQGLE

SEQ ID NO: 111 - protein, 41 aa, Artificial sequence
  HER-lm32 (MPM M5C F11C) (H) Constructs
KSLSLSPGSGGGSCGAQTNCMPMDQDEALLYEEFILQQGLE

SEQ ID NO: 112 - protein, 36 aa, Artificial sequence
  HER-lm32 (MPM D5 N10C G30C) (H) Constructs
KSLSLSPGSGGGSCFMPMDQDEALLYEEFILQQCLE

SEQ ID NO: 113 - protein, 36 aa, Artificial sequence
  HER-lm32 (MPM D5 N10C L28C) (H) Constructs
KSLSLSPGSGGGSCFMPMDQDEALLYEEFICQQGLE

SEQ ID NO: 114-135 - skipped (22 entries)

SEQ ID NO: 136 - protein, 12 aa, Artificial Sequence
  ANG2
SACDHPMNNKCG

SEQ ID NO: 137 - protein, 12 aa, Artificial Sequence
  ANG4
SACGTFTHPQCG

SEQ ID NO: 138 - protein, 12 aa, Artificial Sequence
  ANG6
SACHPMAPKSCG

SEQ ID NO: 139 - protein, 12 aa, Artificial Sequence
  ANG7
SACGSYNHPMCG

SEQ ID NO: 140 - protein, 12 aa, Artificial Sequence
  ANG8
SACGSYEHPMCG

SEQ ID NO: 141 - protein, 15 aa, Artificial Sequence
  ANG10
SACQSSVCFFVRWRF

SEQ ID NO: 142 - protein, 12 aa, Artificial Sequence
  ANG12
SACHPLIHNRCG

SEQ ID NO: 143 - protein, 10 aa, Artificial Sequence
  ANG18
TCIFNFPACI

SEQ ID NO: 144 - protein, 11 aa, Artificial Sequence
  ANG19
FCDEYTPAWCW

SEQ ID NO: 145 - protein, 12 aa, Artificial Sequence
  ANG20
MCPDFGMFIYCI

SEQ ID NO: 146 - protein, 32 aa, Artificial Sequence
  ANG22
QCQEVISACFGQAGQGGGSGGSQCWLMELVCL

SEQ ID NO: 147 - protein, 10 aa, Artificial Sequence
  ANG23
KCPDMWPQCW

SEQ ID NO: 148 - protein, 10 aa, Artificial Sequence
  ANG24
KCPDMWPMCW

SEQ ID NO: 149 - protein, 27 aa, Artificial Sequence
  ANG25
QCEWIWVACDGQAGPAGFCYEHMLMCA

SEQ ID NO: 150 - protein, 10 aa, Artificial Sequence
  ANG26
RCYEVWWDCA

SEQ ID NO: 151 - protein, 10 aa, Artificial Sequence
  ANG27
ACIPDLFLCM

SEQ ID NO: 152 - protein, 10 aa, Artificial Sequence
  ANG28
QCMWMWYQCR

SEQ ID NO: 153 - protein, 10 aa, Artificial Sequence
  ANG29
KCPDMWPECW

SEQ ID NO: 154 - protein, 10 aa, Artificial Sequence
  ANG30
PCQYWWVLCP

SEQ ID NO: 155 - protein, 10 aa, Artificial Sequence
  ANG31
LCWNHWWMCE

SEQ ID NO: 156 - protein, 11 aa, Artificial Sequence
  ANG32
FCHEYTPACCW

SEQ ID NO: 157 - protein, 10 aa, Artificial Sequence
  ANG33
KCPDFWPECW

SEQ ID NO: 158 - protein, 10 aa, Artificial Sequence
  ANG34
ECYHHWPECM

SEQ ID NO: 159 - protein, 11 aa, Artificial Sequence
  ANG35
RCPDMWFPACW

SEQ ID NO: 160 - protein, 11 aa, Artificial Sequence
  ANG37
ICIYWKDPWCY

SEQ ID NO: 161 - protein, 10 aa, Artificial Sequence
  ANG38
KCPDLWPQCY

SEQ ID NO: 162 - protein, 32 aa, Artificial Sequence
  ANG40
YCWVIAKSCVGQAGQGGGGGGSICRHYVWRCE

SEQ ID NO: 163 - protein, 10 aa, Artificial Sequence
  ANG41
LCWNHWWMCD

SEQ ID NO: 164 - protein, 32 aa, Artificial Sequence
  ANG42
MCTWQFMVCPGQAGQGGGSGGSYCWEYVYRCD

SEQ ID NO: 165 - protein, 10 aa, Artificial Sequence
  ANG43
MCWNHWWMCE

SEQ ID NO: 166 - protein, 10 aa, Artificial Sequence
  ANG46
HCIFNFPACI

SEQ ID NO: 167 - protein, 10 aa, Artificial Sequence
  ANG47
LCFNHWWMCP

SEQ ID NO: 168 - protein, 11 aa, Artificial Sequence
  ANG49
MCIYWKEPWCY

SEQ ID NO: 169 - protein, 12 aa, Artificial Sequence
  ANG50
WCDHTEAWPECF

SEQ ID NO: 170 - protein, 12 aa, Artificial Sequence
  ANG51
ECYWYPNPMWCY

SEQ ID NO: 171 - protein, 11 aa, Artificial Sequence
  ANG52
HCPWGTTMNCV

SEQ ID NO: 172 - protein, 12 aa, Artificial Sequence
  ANG54
ECTDYPEWRYCQ

SEQ ID NO: 173 - protein, 12 aa, Artificial Sequence
  ANG55
ECFFFPNPWHCY

SEQ ID NO: 174 - protein, 12 aa, Artificial Sequence
  ANG56
PCAWFPNPSFCY

SEQ ID NO: 175 - protein, 12 aa, Artificial Sequence
  ANG58
MCPWWYDHLHCY

SEQ ID NO: 176 - protein, 12 aa, Artificial Sequence
  ANG59
MCPIWYDHQWCH

SEQ ID NO: 177 - protein, 12 aa, Artificial Sequence
  ANG61
ECWWYYNHFWCH

SEQ ID NO: 178 - protein, 12 aa, Artificial Sequence
  ANG62
ECAWFPNPWCCY

SEQ ID NO: 179 - protein, 10 aa, Artificial Sequence
  ANG63
GCWHDGFMCF

SEQ ID NO: 180 - protein, 12 aa, Artificial Sequence
  ANG64
WCDHWIVWPECW

SEQ ID NO: 181 - protein, 12 aa, Artificial Sequence
  ANG65
QCNDYPNWRYCF

SEQ ID NO: 182 - protein, 12 aa, Artificial Sequence
  ANG66
PCAWYPNPEFCY

SEQ ID NO: 183 - protein, 10 aa, Artificial Sequence
  ANG67
LQYEEFYDHV

SEQ ID NO: 184 - protein, 12 aa, Artificial Sequence
  ANG68
QCPYRINHQRCS

SEQ ID NO: 185 - protein, 12 aa, Artificial Sequence
  ANG69
DCVWFPNPDWCY

SEQ ID NO: 186 - protein, 12 aa, Artificial Sequence
  ANG70
FCALFPYMFPCE

SEQ ID NO: 187 - protein, 15 aa, Artificial Sequence
  ANG71
DGSPCAWFPNPSFCY

SEQ ID NO: 188 - protein, 12 aa, Artificial Sequence
  ANG72
VCPWWYDHWLCS

SEQ ID NO: 189 - protein, 12 aa, Artificial Sequence
  ANG73
ECDGWEYHYFCW

SEQ ID NO: 190 - protein, 12 aa, Artificial Sequence
  ANG74
YCPLCQYHYGCF

SEQ ID NO: 191 - protein, 12 aa, Artificial Sequence
  ANG75
SCWWYPNPQWCY

SEQ ID NO: 192 - protein, 12 aa, Artificial Sequence
  ANG76
ECYFLVNMEWCQ

SEQ ID NO: 193 - protein, 12 aa, Artificial Sequence
  ANG77
TCWFWELEFFCI

SEQ ID NO: 194 - protein, 12 aa, Artificial Sequence
  ANG78
KCYWFPNPIECY

SEQ ID NO: 195 - protein, 12 aa, Artificial Sequence
  ANG79
DCAWFPNPAWCH

SEQ ID NO: 196 - protein, 12 aa, Artificial Sequence
  ANG80
HCPYWYDHELCH

SEQ ID NO: 197 - protein, 12 aa, Artificial Sequence
  ANG81
YCPQWYDHWLCT

SEQ ID NO: 198 - protein, 12 aa, Artificial Sequence
  ANG82
NCWEYPNPAWCY

SEQ ID NO: 199 - protein, 12 aa, Artificial Sequence
  ANG83
ECDGWEYHYVCW

SEQ ID NO: 200 - protein, 12 aa, Artificial Sequence
  ANG84
ECYWYPNPWFCY

SEQ ID NO: 201 - protein, 12 aa, Artificial Sequence
  ANG85
DCVDYPGWEYCV

SEQ ID NO: 202 - protein, 13 aa, Artificial Sequence
  ANG86
ECYMLHACYDEGH

SEQ ID NO: 203 - protein, 12 aa, Artificial Sequence
  ANG87
WCDRGTYVMFCD

SEQ ID NO: 204 - protein, 12 aa, Artificial Sequence
  ANG88
TCPVWWDDYWCG

SEQ ID NO: 205 - protein, 12 aa, Artificial Sequence
  ANG89
WCDYGTYVVQCE

SEQ ID NO: 206 - protein, 12 aa, Artificial Sequence
  ANG90
HCYWHPSPSWCY

SEQ ID NO: 207 - protein, 12 aa, Artificial Sequence
  ANG91
QCYWFPNPLECY

SEQ ID NO: 208 - protein, 12 aa, Artificial Sequence
  ANG93
QCKWFPNPKECY

SEQ ID NO: 209 - protein, 12 aa, Artificial Sequence
  ANG94
PCPYYFNRQHCV

SEQ ID NO: 210 - protein, 12 aa, Artificial Sequence
  ANG95
ICYVYGLEEWCI

SEQ ID NO: 211 - protein, 12 aa, Artificial Sequence
  ANG98
HCPLWYDHYFCA

SEQ ID NO: 212 - protein, 12 aa, Artificial Sequence
  ANG101
ACAWYPNPVECY

SEQ ID NO: 213 - protein, 12 aa, Artificial Sequence
  ANG102
ECAIYPNPQWCY

SEQ ID NO: 214 - protein, 12 aa, Artificial Sequence
  ANG103
DCYYYPNPSWCW

SEQ ID NO: 215 - protein, 12 aa, Artificial Sequence
  ANG104
DCYYFPNPQWCF

SEQ ID NO: 216 - protein, 12 aa, Artificial Sequence
  ANG106
QCPWWYDHYWCN

SEQ ID NO: 217 - protein, 12 aa, Artificial Sequence
  ANG107
FCDFYDYHYVCF

SEQ ID NO: 218 - protein, 12 aa, Artificial Sequence
  ANG108
VCPYWWDHWLCL

SEQ ID NO: 219 - protein, 12 aa, Artificial Sequence
  ANG109
MCPFWYDHELCV

SEQ ID NO: 220 - protein, 12 aa, Artificial Sequence
  ANG110
ICPWWYDHYTCF

SEQ ID NO: 221 - protein, 12 aa, Artificial Sequence
  ANG111
ACDWFQNPYVCW

SEQ ID NO: 222 - protein, 12 aa, Artificial Sequence
  ANG112
PCAWYPNPAECY

SEQ ID NO: 223 - protein, 12 aa, Artificial Sequence
  ANG113
ECPFWYDHYMCM

SEQ ID NO: 224 - protein, 12 aa, Artificial Sequence
  ANG114
PCHWFPNPTECY

SEQ ID NO: 225 - protein, 12 aa, Artificial Sequence
  ANG116
ECYTFPNPQFCY

SEQ ID NO: 226 - protein, 12 aa, Artificial Sequence
  ANG118
SCYSYPNPAWCY

SEQ ID NO: 227 - protein, 12 aa, Artificial Sequence
  ANG119
ECYWYPNPHWCR

SEQ ID NO: 228 - protein, 12 aa, Artificial Sequence
  ANG120
HCYWHPSPNWCR

SEQ ID NO: 229 - protein, 12 aa, Artificial Sequence
  ANG121
HCPDWYNHQLCP

SEQ ID NO: 230 - protein, 12 aa, Artificial Sequence
  ANG122
ACVWFPNPDWCY

SEQ ID NO: 231 - protein, 18 aa, Artificial Sequence
  ANG123
LGPVLLECYFYPNPQHCY

SEQ ID NO: 232 - protein, 18 aa, Artificial Sequence
  ANG126
VPIDCYFYPNPPECYLHN

SEQ ID NO: 233 - protein, 18 aa, Artificial Sequence
  ANG128
GYRDCYFYPNPRHCYGSH

SEQ ID NO: 234 - protein, 18 aa, Artificial Sequence
  ANG129
VVVEFWECYVYPNPPHCY

SEQ ID NO: 235 - protein, 18 aa, Artificial Sequence
  ANG130
LVNDCFFFPNPPHCYVSS

SEQ ID NO: 236 - protein, 18 aa, Artificial Sequence
  ANG131
RMADCYFYPNPQHCYTEG

SEQ ID NO: 237 - protein, 18 aa, Artificial Sequence
  ANG132
DEQACYFYPNPAHCYQRD

SEQ ID NO: 238 - protein, 18 aa, Artificial Sequence
  ANG133
FLGAMMDCYFFPNPPHCY

SEQ ID NO: 239 - protein, 18 aa, Artificial Sequence
  ANG134
VYQDCYNFPNPVHCYRTT

SEQ ID NO: 240 - protein, 18 aa, Artificial Sequence
  ANG135
LVDYSMDCYFFPNPPHCY

SEQ ID NO: 241 - protein, 18 aa, Artificial Sequence
  ANG136
HSLIYHDCYFYPNPPHCY

SEQ ID NO: 242 - protein, 18 aa, Artificial Sequence
  ANG137
LLSVLLECYFYPNPPHCY

SEQ ID NO: 243 - protein, 18 aa, Artificial Sequence
  ANG138
PTDVLLECYLYPNPPHCY

SEQ ID NO: 244 - protein, 18 aa, Artificial Sequence
  ANG139
SLPLRAFCYFPPNWPHCY

SEQ ID NO: 245 - protein, 18 aa, Artificial Sequence
  ANG142
TDTDCYFFPNPPHCYSPG

SEQ ID NO: 246 - protein, 18 aa, Artificial Sequence
  ANG143
IYDDCYIFPNPHHCYVGF

SEQ ID NO: 247 - protein, 18 aa, Artificial Sequence
  ANG144
PWHECYWYPNPPHCYGIL

SEQ ID NO: 248 - protein, 18 aa, Artificial Sequence
  ANG145
MPLIFSECYSYPNPPHCY

SEQ ID NO: 249 - protein, 18 aa, Artificial Sequence
  ANG148
GNFAHEECYFYPNPAHCY

SEQ ID NO: 250 - protein, 18 aa, Artificial Sequence
  ANG149
QPRLLHDCYFYPNPSHCY

SEQ ID NO: 251 - protein, 18 aa, Artificial Sequence
  ANG150
NPTDCYFYPNPQHCYNWG

SEQ ID NO: 252 - protein, 18 aa, Artificial Sequence
  ANG151
YPFFLVDCYFFPNPLHCY

SEQ ID NO: 253 - protein, 18 aa, Artificial Sequence
  ANG153
SVAHVHGLLLLPESDALL

SEQ ID NO: 254 - protein, 18 aa, Artificial Sequence
  ANG154
GEYDCYFYPNPPHCYDRN

SEQ ID NO: 255 - protein, 18 aa, Artificial Sequence
  ANG156
LHVDCYFYPNPPHCYIDE

SEQ ID NO: 256 - protein, 18 aa, Artificial Sequence
  ANG157
QDHDCYFYPNPPHCYLEG

SEQ ID NO: 257 - protein, 18 aa, Artificial Sequence
  ANG158
HFSDCFFYPNPQHCYHMM

SEQ ID NO: 258 - protein, 18 aa, Artificial Sequence
  ANG159
PIEDCYFYPNPRHCYLQP

SEQ ID NO: 259 - protein, 18 aa, Artificial Sequence
  ANG160
ECCYCYNYDTWSHCCQKG

SEQ ID NO: 260 - protein, 18 aa, Artificial Sequence
  ANG161
VVLPSYDCYFYPNPPHCY

SEQ ID NO: 261 - protein, 18 aa, Artificial Sequence
  ANG163
VPWDCYFYPNPPHCYEDA

SEQ ID NO: 262 - protein, 18 aa, Artificial Sequence
  ANG164
FVSSAFDCYFYPNPAHCY

SEQ ID NO: 263 - protein, 18 aa, Artificial Sequence
  ANG165
ALVECYFYPNPLHCYNTS

SEQ ID NO: 264 - protein, 18 aa, Artificial Sequence
  ANG166
FWYSLDDCYFYPNPSHCY

SEQ ID NO: 265 - protein, 18 aa, Artificial Sequence
  ANG169
RSNLMTDCYYYPNPPHCY

SEQ ID NO: 266 - protein, 18 aa, Artificial Sequence
  ANG172
QLVDCLYYPNPPHCYESM

SEQ ID NO: 267 - protein, 18 aa, Artificial Sequence
  ANG174
WDVDCGFFPNPAYCYELG

SEQ ID NO: 268 - protein, 18 aa, Artificial Sequence
  ANG175
LQGRMIDCYSYPNPPHCY

SEQ ID NO: 269 - protein, 18 aa, Artificial Sequence
  ANG176
QRDPLAACYIYPNPPHCY

SEQ ID NO: 270 - protein, 18 aa, Artificial Sequence
  ANG179
LLWECYFYPNPSHCYTDR

SEQ ID NO: 271 - protein, 18 aa, Artificial Sequence
  ANG180
QDIDCYFYPNPPHCYHVT

SEQ ID NO: 272 - protein, 18 aa, Artificial Sequence
  ANG182
RLHDCYFYPNPPHCYLWQ

SEQ ID NO: 273 - protein, 18 aa, Artificial Sequence
  ANG183
SLTTFIDCYFYPNPPHCY

SEQ ID NO: 274 - protein, 18 aa, Artificial Sequence
  ANG186
SSGPDIDCYFYPNPPHCY

SEQ ID NO: 275 - protein, 18 aa, Artificial Sequence
  ANG187
DCYFYPNPLYCYEDWDYT

SEQ ID NO: 276 - protein, 18 aa, Artificial Sequence
  ANG188
IWLDCYFYPNPPHCSLNS

SEQ ID NO: 277 - protein, 18 aa, Artificial Sequence
  ANG189
QWNDCYFYPNPPHCYGRQ

SEQ ID NO: 278 - protein, 18 aa, Artificial Sequence
  ANG190
GHMDCYYYPNPSHCYQQL

SEQ ID NO: 279 - protein, 18 aa, Artificial Sequence
  ANG192
WLSQCYSYPNPPHCYTLF

SEQ ID NO: 280 - protein, 18 aa, Artificial Sequence
  ANG193
SSLHMLDCYYYPNPPHCY

SEQ ID NO: 281 - protein, 18 aa, Artificial Sequence
  ANG194
QSLSFLDCYFYPNPLHCY

SEQ ID NO: 282 - protein, 18 aa, Artificial Sequence
  ANG197
NYYYCYLSPNPPHCYLSF

SEQ ID NO: 283 - protein, 18 aa, Artificial Sequence
  ANG198
HFSDCYYFPNPPHCYESI

SEQ ID NO: 284 - protein, 18 aa, Artificial Sequence
  ANG199
EVLDCFFYPNPPHCYKAL

SEQ ID NO: 285 - protein, 18 aa, Artificial Sequence
  ANG201
RDTDCYFYPNPAHCYLGT

SEQ ID NO: 286 - protein, 18 aa, Artificial Sequence
  ANG203
KCPMLPDWVSCDEWMLQK

SEQ ID NO: 287 - protein, 18 aa, Artificial Sequence
  ANG210
LSLKCPLLPDWISCDEYY

SEQ ID NO: 288 - protein, 18 aa, Artificial Sequence
  ANG211
KCPLLPDWLSCLEWQLME

SEQ ID NO: 289 - protein, 18 aa, Artificial Sequence
  ANG215
KCPLLPDWVPCHEWLNVW

SEQ ID NO: 290 - protein, 18 aa, Artificial Sequence
  ANG217
AMSLCPLLPDWASCNDYL

SEQ ID NO: 291 - protein, 18 aa, Artificial Sequence
  ANG218
LCPRLPDWVSCHTWLERY

SEQ ID NO: 292 - protein, 18 aa, Artificial Sequence
  ANG219
LSTKCPLLPDWVSCHEWL

SEQ ID NO: 293 - protein, 18 aa, Artificial Sequence
  ANG220
LGWTELKCPLLPDWATCN

SEQ ID NO: 294 - protein, 18 aa, Artificial Sequence
  ANG222
KCPLLPDWVSCHEWNVWL

SEQ ID NO: 295 - protein, 18 aa, Artificial Sequence
  ANG2 binding MRD
KCPLLPDWISCAQWQRAV

SEQ ID NO: 296 - protein, 18 aa, Artificial Sequence
  ANG2 binding MRD
VGSLCPLLPDWASCHEWL

SEQ ID NO: 297 - protein, 18 aa, Artificial Sequence
  ANG2 binding MRD
RCPFLPDWLSCNEWLMIE

SEQ ID NO: 298 - protein, 18 aa, Artificial Sequence
  ANG2 binding MRD
WYRKCPLLPDWVSCHEWY

SEQ ID NO: 299 - protein, 18 aa, Artificial Sequence
  ANG2 binding MRD
TTLNCPLLPDWLTCQEFL

SEQ ID NO: 300 - protein, 18 aa, Artificial Sequence
  ANG2 binding MRD
KCPLLPDWASCESWLEVR

SEQ ID NO: 301 - protein, 18 aa, Artificial Sequence
  ANG2 binding MRD
HLDKCPLLPDWISCTDWL

SEQ ID NO: 302 - protein, 18 aa, Artificial Sequence
  ANG2 binding MRD
KCPLLPDWVTCDEFQGMQ

SEQ ID NO: 303 - protein, 18 aa, Artificial Sequence
  ANG2 binding MRD
ATSKCPLLPDWVSCDEHL

SEQ ID NO: 304 - protein, 18 aa, Artificial Sequence
  ANG2 binding MRD
SSGKCPLLPDWKSCDEWL

SEQ ID NO: 305 - protein, 18 aa, Artificial Sequence
  ANG2 binding MRD
KCPLLPDWVSCHEWNIRE

SEQ ID NO: 306 - protein, 18 aa, Artificial Sequence
  ANG2 binding MRD
KCPLLPDWFSCHEYQEMF

SEQ ID NO: 307 - protein, 18 aa, Artificial Sequence
  ANG2 binding MRD
KCPLLPDWVSCHTYLEES

SEQ ID NO: 308 - protein, 18 aa, Artificial Sequence
  ANG2 binding MRD
EPPKCPMLPDWVSCDTWL

SEQ ID NO: 309 - protein, 18 aa, Artificial Sequence
  ANG2 binding MRD
DVPHQLNCPLLPDWAACL

SEQ ID NO: 310 - protein, 18 aa, Artificial Sequence
  ANG2 binding MRD
EISKCPLLPDWVSCYQWL

SEQ ID NO: 311 - protein, 18 aa, Artificial Sequence
  ANG2 binding MRD
MNVKCPLLPDWVSCLDYL

SEQ ID NO: 312 - protein, 18 aa, Artificial Sequence
  ANG2 binding MRD
MLMKCPLLPDWASCDVWL

SEQ ID NO: 313 - protein, 18 aa, Artificial Sequence
  ANG2 binding MRD
LMHECPLLPDWVSCHTFL

SEQ ID NO: 314 - protein, 18 aa, Artificial Sequence
  ANG2 binding MRD
KCPLLPDWVSCETYLNGD

SEQ ID NO: 315 - protein, 18 aa, Artificial Sequence
  ANG2 binding MRD
KCPLLPDWVSCDMYLERQ

SEQ ID NO: 316 - protein, 18 aa, Artificial Sequence
  ANG2 binding MRD
KCPLLPDWASCDQWNEWN

SEQ ID NO: 317 - protein, 18 aa, Artificial Sequence
  ANG2 binding MRD
YVSKCPFLPDWVSCHGWL

SEQ ID NO: 318 - protein, 18 aa, Artificial Sequence
  ANG2 binding MRD
KCPFLPDWVSCHDYSQKY

SEQ ID NO: 319 - protein, 18 aa, Artificial Sequence
  ANG2 binding MRD
FPPKCPLRPDWVSCHERH

SEQ ID NO: 320 - protein, 18 aa, Artificial Sequence
  ANG2 binding MRD
ECPLLPDWVSCHEWNRLH

SEQ ID NO: 321 - protein, 18 aa, Artificial Sequence
  ANG2 binding MRD
SPVKCPFLPDWISCDLYL

SEQ ID NO: 322 - protein, 18 aa, Artificial Sequence
  ANG2 binding MRD
TAFKCPPLPDWVSCLDWL

SEQ ID NO: 323 - protein, 18 aa, Artificial Sequence
  ANG2 binding MRD
KCPLLPDWVSCQEWLSSK

SEQ ID NO: 324 - protein, 18 aa, Artificial Sequence
  ANG2 binding MRD
HYDKCPLLPDWVSCHEFL

SEQ ID NO: 325 - protein, 18 aa, Artificial Sequence
  ANG2 binding MRD
GLRKCPVLPDWVSCDNWL

SEQ ID NO: 326 - protein, 18 aa, Artificial Sequence
  ANG2 binding MRD
SGFKCPLLPDWVSCTDCT

SEQ ID NO: 327 - protein, 18 aa, Artificial Sequence
  ANG2 binding MRD
LASKCPLLPDWISCQTWL

SEQ ID NO: 328 - protein, 18 aa, Artificial Sequence
  ANG2 binding MRD
KCPLLPDWVSCDQWRLLE

SEQ ID NO: 329 - protein, 18 aa, Artificial Sequence
  ANG2 binding MRD
YFDKCPLLPDWLTCHEWM

SEQ ID NO: 330 - protein, 18 aa, Artificial Sequence
  ANG2 binding MRD
LPSKCPLLPDWTSCDEYL

SEQ ID NO: 331 - protein, 18 aa, Artificial Sequence
  ANG2 binding MRD
KSVSMKTCQDYPGWRYCQ

SEQ ID NO: 332 - protein, 18 aa, Artificial Sequence
  ANG2 binding MRD
VNVFLKTCQDYPGWRYCH

SEQ ID NO: 333 - protein, 18 aa, Artificial Sequence
  ANG2 binding MRD
PWPDCPVYRYCRHCHHKT

SEQ ID NO: 334 - protein, 18 aa, Artificial Sequence
  ANG2 binding MRD
TGSTAKYCQDYPGWRYCH

SEQ ID NO: 335 - protein, 18 aa, Artificial Sequence
  ANG2 binding MRD
LPMECYFYPNPEHCYLVP

SEQ ID NO: 336 - protein, 18 aa, Artificial Sequence
  ANG2 binding MRD
TYTKCMTYPNPQYCFKHS

SEQ ID NO: 337 - protein, 18 aa, Artificial Sequence
  ANG2 binding MRD
RFLECAWFPTPYFCHESE

SEQ ID NO: 338 - protein, 15 aa, Artificial Sequence
  ANG2 binding MRD
QYDPCEYYIPCVKWG

SEQ ID NO: 339 - protein, 18 aa, Artificial Sequence
  ANG2 binding MRD
GFHRCSTFPNPHYCYKTH

SEQ ID NO: 340 - protein, 19 aa, Artificial Sequence
  ANG2 binding MRD
RWSYCEETMIGYPYCFTRP

SEQ ID NO: 341 - protein, 21 aa, Artificial Sequence
  ANG2 binding MRD
AAFMLSCHSTDGQSWACMESH

SEQ ID NO: 342 - protein, 18 aa, Artificial Sequence
  ANG2 binding MRD
RSFECRWQPEHPICAKGV

SEQ ID NO: 343 - protein, 18 aa, Artificial Sequence
  ANG2 binding MRD
ILLRCAWYPAPPWCNIET

SEQ ID NO: 344 - protein, 17 aa, Artificial Sequence
  ANG2 binding MRD
PHVICHYWKHPWCFQNS

SEQ ID NO: 345 - protein, 18 aa, Artificial Sequence
  ANG2 binding MRD
VFYRCMKWPNPWWCYSQP

SEQ ID NO: 346 - protein, 18 aa, Artificial Sequence
  ANG2 binding MRD
GFQRCKTFPNPHYCYKTH

SEQ ID NO: 347 - protein, 18 aa, Artificial Sequence
  ANG2 binding MRD
DWSKCPKYPNPEWCYHPS

SEQ ID NO: 348 - protein, 18 aa, Artificial Sequence
  ANG2 binding MRD
TYTKCMTYPNPQYCFKHN

SEQ ID NO: 349 - protein, 18 aa, Artificial Sequence
  ANG2 binding MRD
SMWGCHMQPNYRECSLWI

SEQ ID NO: 350 - protein, 17 aa, Artificial Sequence
  ANG2 binding MRD
PHVICHYCPHPWCFLNS

SEQ ID NO: 351 - protein, 18 aa, Artificial Sequence
  ANG2 binding MRD
LELPCGKYPNMWFCYKVA

SEQ ID NO: 352 - protein, 17 aa, Artificial Sequence
  ANG2 binding MRD
KERPCVWWKQPWCFQAS

SEQ ID NO: 353 - protein, 18 aa, Artificial Sequence
  ANG2 binding MRD
QWFRCYEFPEPDWCRVRS

SEQ ID NO: 354 - protein, 18 aa, Artificial Sequence
  ANG2 binding MRD
EWAFCYSYPNPDYCHEAV

SEQ ID NO: 355 - protein, 18 aa, Artificial Sequence
  ANG2 binding MRD
TYRKCMTYPNPHYCFKHS

SEQ ID NO: 356 - protein, 18 aa, Artificial Sequence
  ANG2 binding MRD
RYSLCMTYPNPYQCYKSN

SEQ ID NO: 357 - protein, 17 aa, Artificial Sequence
  ANG2 binding MRD
PHVICHYWKHPWCFHNS

SEQ ID NO: 358 - protein, 18 aa, Artificial Sequence
  ANG2 binding MRD
PWFSCYYFPNPSHCMDVV

SEQ ID NO: 359 - protein, 18 aa, Artificial Sequence
  ANG2 binding MRD
LYDRCVCFPNLFWCEMTT

SEQ ID NO: 360 - protein, 20 aa, Artificial Sequence
  ANG2 binding MRD
RSLACEFHPQKYHVQCALPH

SEQ ID NO: 361 - protein, 20 aa, Artificial Sequence
  ANG2 binding MRD
NTLRCYSGVLVDAMVCFTSG

SEQ ID NO: 362 - protein, 15 aa, Artificial Sequence
  ANG2 binding MRD
QYDPCEYDIPCVKWG

SEQ ID NO: 363 - protein, 18 aa, Artificial Sequence
  ANG2 binding MRD
SWAQCYAYPNPDFCNRSG

SEQ ID NO: 364 - protein, 18 aa, Artificial Sequence
  ANG2 binding MRD
PYEKCMTYPNPWYCFLTD

SEQ ID NO: 365 - protein, 18 aa, Artificial Sequence
  ANG2 binding MRD
PYERCTKHPNPTYCWKNL

SEQ ID NO: 366 - protein, 18 aa, Artificial Sequence
  ANG2 binding MRD
MYAMCQWHPSPEQCRSPS

SEQ ID NO: 367 - protein, 12 aa, Artificial Sequence
  ANG2 binding MRD
KCPLLPDWASCR

SEQ ID NO: 368 - protein, 18 aa, Artificial Sequence
  ANG2 binding MRD
TYLQIIECYFYPNPPHCY

SEQ ID NO: 369 - protein, 18 aa, Artificial Sequence
  ANG2 binding MRD
LTPSGSDCYFYPNPLHCY

SEQ ID NO: 370 - protein, 18 aa, Artificial Sequence
  ANG2 binding MRD
GAYDCYFYPNPPHCYGTT

SEQ ID NO: 371 - protein, 18 aa, Artificial Sequence
  ANG2 binding MRD
YLNHNYECYFFPNPTHCY

SEQ ID NO: 372 - protein, 18 aa, Artificial Sequence
  ANG2 binding MRD
GFLTFYDCYFFPNPPHCF

SEQ ID NO: 373 - protein, 18 aa, Artificial Sequence
  ANG2 binding MRD
TFIDCYFYPNPPHCYALW

SEQ ID NO: 374 - protein, 18 aa, Artificial Sequence
  ANG2 binding MRD
ASDILLDCYFFPNPPHCR

SEQ ID NO: 375 - protein, 18 aa, Artificial Sequence
  ANG2 binding MRD
LPLSWSDCYFYPNPPHCY

SEQ ID NO: 376 - protein, 18 aa, Artificial Sequence
  ANG2 binding MRD
ALLDCYFYPNPAHCYITM

SEQ ID NO: 377 - protein, 18 aa, Artificial Sequence
  ANG2 binding MRD
GMLDCYFYPNPPHCYLDR

SEQ ID NO: 378 - protein, 18 aa, Artificial Sequence
  ANG2 binding MRD
SGTECYFYPNPPHCYSSD

SEQ ID NO: 379 - protein, 18 aa, Artificial Sequence
  ANG2 binding MRD
SLEDCFFYPNPTLCYNNG

SEQ ID NO: 380 - protein, 18 aa, Artificial Sequence
  ANG2 binding MRD
AFSRFLDCYFYPNPQHCY

SEQ ID NO: 381 - protein, 18 aa, Artificial Sequence
  ANG2 binding MRD
GVYSFLECSFFPNPPYCY

SEQ ID NO: 382 - protein, 18 aa, Artificial Sequence
  ANG2 binding MRD
EEGSSSDCYFYPNPRHCY

SEQ ID NO: 383 - protein, 18 aa, Artificial Sequence
  ANG2 binding MRD
LTLLLDDCYFYPNPPHCY

SEQ ID NO: 384 - protein, 18 aa, Artificial Sequence
  ANG2 binding MRD
LFHSMTDCYFYPNPRHCY

SEQ ID NO: 385 - protein, 18 aa, Artificial Sequence
  ANG2 binding MRD
REQDCFFYPNPPHCYVDN

SEQ ID NO: 386 - protein, 18 aa, Artificial Sequence
  ANG2 binding MRD
ASLGLYDCYYFPNPPNCY

SEQ ID NO: 387 - protein, 18 aa, Artificial Sequence
  ANG2 binding MRD
RTGTLGDCYFYPNPRHCY

SEQ ID NO: 388 - protein, 18 aa, Artificial Sequence
  ANG2 binding MRD
SPLDCYFYPNPPHCYYAH

SEQ ID NO: 389 - protein, 18 aa, Artificial Sequence
  ANG2 binding MRD
IEGDCYFYPNPPHCYEQN

SEQ ID NO: 390 - protein, 18 aa, Artificial Sequence
  ANG2 binding MRD
FNYSMYDCYFYPNPAHCY

SEQ ID NO: 391 - protein, 18 aa, Artificial Sequence
  ANG2 binding MRD
LVLPLFDCYFYPNPPHCY

SEQ ID NO: 392 - protein, 18 aa, Artificial Sequence
  ANG2 binding MRD
FHFVLYDCYFYPNPPYCF

SEQ ID NO: 393 - protein, 18 aa, Artificial Sequence
  ANG2 binding MRD
HRADCYFFPNPMDCYQWR

SEQ ID NO: 394 - protein, 18 aa, Artificial Sequence
  ANG2 binding MRD
STNLALDCYFYPNPPHCY

SEQ ID NO: 395 - protein, 18 aa, Artificial Sequence
  ANG2 binding MRD
SPNDCYFYPNPPECYTHR

SEQ ID NO: 396 - protein, 18 aa, Artificial Sequence
  ANG2 binding MRD
IVITSLACYFYPNPLHCY

SEQ ID NO: 397 - protein, 18 aa, Artificial Sequence
  ANG2 binding MRD
GGVPMTDCYFYPNPRHCY

SEQ ID NO: 398 - protein, 18 aa, Artificial Sequence
  ANG2 binding MRD
DFRDCYSFPNPTQCYINT

SEQ ID NO: 399 - protein, 18 aa, Artificial Sequence
  ANG2 binding MRD
WPTDCFFFPNPPHCYHDG

SEQ ID NO: 400 - protein, 18 aa, Artificial Sequence
  ANG2 binding MRD
HILDCYFYPNPPHCYLVT

SEQ ID NO: 401 - protein, 18 aa, Artificial Sequence
  ANG2 binding MRD
DEADCYYYPNPPHCYSGH

SEQ ID NO: 402 - protein, 18 aa, Artificial Sequence
  ANG2 binding MRD
TLVSMMDCYYYPNPPHCY

SEQ ID NO: 403 - protein, 18 aa, Artificial Sequence
  ANG2 binding MRD
QSVRYMDCYFYPNPSHCY

SEQ ID NO: 404 - protein, 18 aa, Artificial Sequence
  ANG2 binding MRD
WYDPYYACYFYPNPTYCY

SEQ ID NO: 405 - protein, 18 aa, Artificial Sequence
  ANG2 binding MRD
LSGPFLDCYFYPNPTHCY

SEQ ID NO: 406 - protein, 18 aa, Artificial Sequence
  ANG2 binding MRD
VMLDCYFYPNPLDCYWLT

SEQ ID NO: 407 - protein, 18 aa, Artificial Sequence
  ANG2 binding MRD
SSLEHNDCYFYPNPMHCY

SEQ ID NO: 408 - protein, 18 aa, Artificial Sequence
  ANG2 binding MRD
RHVDCYFYPNPPHCYLVL

SEQ ID NO: 409 - protein, 18 aa, Artificial Sequence
  ANG2 binding MRD
IYPECYFYPNPKSCYSDQ

SEQ ID NO: 410 - protein, 18 aa, Artificial Sequence
  ANG2 binding MRD
PPTSLADCYFFPNPLHCY

SEQ ID NO: 411 - protein, 18 aa, Artificial Sequence
  ANG2 binding MRD
LLAACYFYPNPPLCFTST

SEQ ID NO: 412 - protein, 18 aa, Artificial Sequence
  ANG2 binding MRD
GEEDCYFYPNPPHCYSEL

SEQ ID NO: 413 - protein, 18 aa, Artificial Sequence
  ANG2 binding MRD
ECYFYPNPPHCYMEHRST

SEQ ID NO: 414 - protein, 18 aa, Artificial Sequence
  ANG2 binding MRD
TEIECYFYPNPPQCYAIH

SEQ ID NO: 415 - protein, 18 aa, Artificial Sequence
  ANG2 binding MRD
PRMDCYFYPNPPHCYNGQ

SEQ ID NO: 416 - protein, 18 aa, Artificial Sequence
  ANG2 binding MRD
MSLPHQNCYFFPNPTYCY

SEQ ID NO: 417 - protein, 18 aa, Artificial Sequence
  ANG2 binding MRD
YGDECYFFPNPPHCFSWD

SEQ ID NO: 418 - protein, 18 aa, Artificial Sequence
  ANG2 binding MRD
FFESSFDCYFFPNPNHCY

SEQ ID NO: 419 - protein, 18 aa, Artificial Sequence
  ANG2 binding MRD
MLVVPSDCYFYPNPSHCY

SEQ ID NO: 420 - protein, 18 aa, Artificial Sequence
  ANG2 binding MRD
LQVDSLDCYFYPNPPHCY

SEQ ID NO: 421 - protein, 18 aa, Artificial Sequence
  ANG2 binding MRD
QLMDCYFFPNPHHCFESK

SEQ ID NO: 422 - protein, 18 aa, Artificial Sequence
  ANG2 binding MRD
DCYFYPNPPHCYNERYEA

SEQ ID NO: 423 - protein, 18 aa, Artificial Sequence
  ANG2 binding MRD
SDMDCYFYPNPPHCFTPP

SEQ ID NO: 424 - protein, 20 aa, Artificial Sequence
  ANG2 binding MRD
GADTMQWNDCYFFPNPTHCY

SEQ ID NO: 425 - protein, 18 aa, Artificial Sequence
  ANG2 binding MRD
HIKDCYFFPNPPHCYKST

SEQ ID NO: 426 - protein, 18 aa, Artificial Sequence
  ANG2 binding MRD
PHQRHLECYFYPNPPECY

SEQ ID NO: 427 - protein, 18 aa, Artificial Sequence
  ANG2 binding MRD
SYLDFTDCYFYPNPPHCY

SEQ ID NO: 428 - protein, 18 aa, Artificial Sequence
  ANG2 binding MRD
APGYTQDCYWFPNPPHCY

SEQ ID NO: 429 - protein, 18 aa, Artificial Sequence
  ANG2 binding MRD
RFSSFHDCYFYPNPSHCY

SEQ ID NO: 430 - protein, 18 aa, Artificial Sequence
  ANG2 binding MRD
HSHHLTDCYYFPNPLHCY

SEQ ID NO: 431 - protein, 18 aa, Artificial Sequence
  ANG2 binding MRD
AQVDCYFFPNPTHCYFDR

SEQ ID NO: 432 - protein, 18 aa, Artificial Sequence
  ANG2 binding MRD
MGDDCYFYPNPPRCYVKP

SEQ ID NO: 433 - protein, 18 aa, Artificial Sequence
  ANG2 binding MRD
FLADCYLFPNPPHCYLDY

SEQ ID NO: 434 - protein, 18 aa, Artificial Sequence
  ANG2 binding MRD
LGEDCYWYPNPPHCYGML

SEQ ID NO: 435 - protein, 18 aa, Artificial Sequence
  ANG2 binding MRD
NDSVVSECYFFPNPPHCY

SEQ ID NO: 436 - protein, 18 aa, Artificial Sequence
  ANG2 binding MRD
DCYFYPNPPSCYEVQGAS

SEQ ID NO: 437 - protein, 18 aa, Artificial Sequence
  ANG2 binding MRD
GPWECFFYPNPLHCFKEP

SEQ ID NO: 438 - protein, 18 aa, Artificial Sequence
  ANG2 binding MRD
PSADFAECFFYPNPPQCY

SEQ ID NO: 439 - protein, 18 aa, Artificial Sequence
  ANG2 binding MRD
ASNDIHDCYFYPNPPHCY

SEQ ID NO: 440 - protein, 18 aa, Artificial Sequence
  ANG2 binding MRD
SDTDCYFYPNPPHCYWDT

SEQ ID NO: 441 - protein, 18 aa, Artificial Sequence
  ANG2 binding MRD
AFVHCYFFPNPQHCYHRL

SEQ ID NO: 442 - protein, 18 aa, Artificial Sequence
  ANG2 binding MRD
MIFDCYFFPNPRHCYHEG

SEQ ID NO: 443 - protein, 18 aa, Artificial Sequence
  ANG2 binding MRD
SYFLTWDCYTYPNPPHCY

SEQ ID NO: 444 - protein, 18 aa, Artificial Sequence
  ANG2 binding MRD
TGFECYFYPNPRHCYNDI

SEQ ID NO: 445 - protein, 18 aa, Artificial Sequence
  ANG2 binding MRD
LYPSLLDCYFYPNPTHCY

SEQ ID NO: 446 - protein, 18 aa, Artificial Sequence
  ANG2 binding MRD
MVDECYFYPNPPHCYSNT

SEQ ID NO: 447 - protein, 18 aa, Artificial Sequence
  ANG2 binding MRD
PLRSYMDCYWYPNPPHCY

SEQ ID NO: 448 - protein, 18 aa, Artificial Sequence
  ANG2 binding MRD
WLGRLSDCYFYPNPPHCY

SEQ ID NO: 449 - protein, 18 aa, Artificial Sequence
  ANG2 binding MRD
FHIDCYFYPNPPHCYTGA

SEQ ID NO: 450 - protein, 18 aa, Artificial Sequence
  ANG2 binding MRD
NFRECVFYPNPPHCYDFG

SEQ ID NO: 451 - protein, 18 aa, Artificial Sequence
  ANG2 binding MRD
KEIDCYFYPNPPHCYGKW

SEQ ID NO: 452 - protein, 18 aa, Artificial Sequence
  ANG2 binding MRD
TNQDCYFYPNPPHCFRDH

SEQ ID NO: 453 - protein, 18 aa, Artificial Sequence
  ANG2 binding MRD
SNAQCYFYPNPLHCYKNA

SEQ ID NO: 454 - protein, 18 aa, Artificial Sequence
  ANG2 binding MRD
DCYFYPNPPHCYTVEGGK

SEQ ID NO: 455 - protein, 18 aa, Artificial Sequence
  ANG2 binding MRD
QPMDCFFYPNPPHCYAEE

SEQ ID NO: 456 - protein, 18 aa, Artificial Sequence
  ANG2 binding MRD
IVSREYDCYFYPNPTHCY

SEQ ID NO: 457 - protein, 18 aa, Artificial Sequence
  ANG2 binding MRD
SMHDCYYYPNPTHCYRGT

SEQ ID NO: 458 - protein, 18 aa, Artificial Sequence
  ANG2 binding MRD
DETECYWFPSPAHCYKDS

SEQ ID NO: 459 - protein, 18 aa, Artificial Sequence
  ANG2 binding MRD
LGLDCYFYPNPPDCYHDA

SEQ ID NO: 460 - protein, 18 aa, Artificial Sequence
  ANG2 binding MRD
FDEDCYFYPNPPHCYLLS

SEQ ID NO: 461 - protein, 18 aa, Artificial Sequence
  ANG2 binding MRD
EHEACYFYPNPPHCYESS

SEQ ID NO: 462 - protein, 18 aa, Artificial Sequence
  ANG2 binding MRD
PSYNIFECFFFPNPPHCY

SEQ ID NO: 463 - protein, 18 aa, Artificial Sequence
  ANG2 binding MRD
SESDCYFYPNPPHCYAVV

SEQ ID NO: 464 - protein, 18 aa, Artificial Sequence
  ANG2 binding MRD
HPFDCYFYPNPPHCYTRS

SEQ ID NO: 465 - protein, 18 aa, Artificial Sequence
  ANG2 binding MRD
LILDCYFYPNPPHCYTST

SEQ ID NO: 466 - protein, 18 aa, Artificial Sequence
  ANG2 binding MRD
YEFRWTDCYFYPNPPHCF

SEQ ID NO: 467 - protein, 18 aa, Artificial Sequence
  ANG2 binding MRD
QSQNVVECYFYPNPPHCY

SEQ ID NO: 468 - protein, 18 aa, Artificial Sequence
  ANG2 binding MRD
YRLDLSECYYYPNPLHCY

SEQ ID NO: 469 - protein, 18 aa, Artificial Sequence
  ANG2 binding MRD
IPLDCYFYPNPPSCYHSY

SEQ ID NO: 470 - protein, 18 aa, Artificial Sequence
  ANG2 binding MRD
AASQTSDCYFYPNPPSCY

SEQ ID NO: 471 - protein, 18 aa, Artificial Sequence
  ANG2 binding MRD
THLDCYFYPNPPHCYSST

SEQ ID NO: 472 - protein, 18 aa, Artificial Sequence
  ANG2 binding MRD
NTNDPFDCFFYPNPPHCY

SEQ ID NO: 473 - protein, 18 aa, Artificial Sequence
  ANG2 binding MRD
IHKLDLDCYYYPNPPHCY

SEQ ID NO: 474 - protein, 18 aa, Artificial Sequence
  ANG2 binding MRD
FSHPFTDCFFYPNPQHCY

SEQ ID NO: 475 - protein, 18 aa, Artificial Sequence
  ANG2 binding MRD
TVYDCYFYPNPGHCYLQL

SEQ ID NO: 476 - protein, 18 aa, Artificial Sequence
  ANG2 binding MRD
MVFHELDCYFYPNPPHCY

SEQ ID NO: 477 - protein, 18 aa, Artificial Sequence
  ANG2 binding MRD
HSLLHWDCYFYPNPSHCY

SEQ ID NO: 478 - protein, 18 aa, Artificial Sequence
  ANG2 binding MRD
QLRECYWFPNPSHCYIES

SEQ ID NO: 479 - protein, 18 aa, Artificial Sequence
  ANG2 binding MRD
GLVDCYFYPNPPHCYWPH

SEQ ID NO: 480 - protein, 18 aa, Artificial Sequence
  ANG2 binding MRD
LFENSLGCYFFPNPPHCY

SEQ ID NO: 481 - protein, 18 aa, Artificial Sequence
  ANG2 binding MRD
FPPWFQDCFFYPNPPVCY

SEQ ID NO: 482 - protein, 18 aa, Artificial Sequence
  ANG2 binding MRD
HALECYFYPNPLHCYTQP

SEQ ID NO: 483 - protein, 18 aa, Artificial Sequence
  ANG2 binding MRD
DPVDCYFYPNPAHCYSTV

SEQ ID NO: 484 - protein, 18 aa, Artificial Sequence
  ANG2 binding MRD
IVVYSADCFFYPNPRHCY

SEQ ID NO: 485 - protein, 18 aa, Artificial Sequence
  ANG2 binding MRD
RMFDCYFYPNPPLCYNHI

SEQ ID NO: 486 - protein, 18 aa, Artificial Sequence
  ANG2 binding MRD
LWYTTVNCYFCPNPLHCY

SEQ ID NO: 487 - protein, 18 aa, Artificial Sequence
  ANG2 binding MRD
DYLSMLECYFYPNPSHCY

SEQ ID NO: 488 - protein, 18 aa, Artificial Sequence
  ANG2 binding MRD
FMTSGVECYFYPNPPHCY

SEQ ID NO: 489 - protein, 18 aa, Artificial Sequence
  ANG2 binding MRD
LFLNPYDCYFYPNPPQCY

SEQ ID NO: 490 - protein, 18 aa, Artificial Sequence
  ANG2 binding MRD
HQMTQIECYFFPNPQHCY

SEQ ID NO: 491 - protein, 18 aa, Artificial Sequence
  ANG2 binding MRD
PWSPCYWYPNPRFCYEAS

SEQ ID NO: 492 - protein, 18 aa, Artificial Sequence
  ANG2 binding MRD
LLVDCYYYPNPTHCSKNS

SEQ ID NO: 493 - protein, 18 aa, Artificial Sequence
  ANG2 binding MRD
DCYFYPNPPHCYHDNEIE

SEQ ID NO: 494 - protein, 18 aa, Artificial Sequence
  ANG2 binding MRD
PLLPFYDCYFYPNPSHCY

SEQ ID NO: 495 - protein, 18 aa, Artificial Sequence
  ANG2 binding MRD
LVVDCYFYPNPPHCYDYS

SEQ ID NO: 496 - protein, 18 aa, Artificial Sequence
  ANG2 binding MRD
RPSMHMECYFYPNPPYCY

SEQ ID NO: 497 - protein, 18 aa, Artificial Sequence
  ANG2 binding MRD
GFLTSLDCYFYPNPPHCY

SEQ ID NO: 498 - protein, 18 aa, Artificial Sequence
  ANG2 binding MRD
EVPDCYYYPNPPHCYEAN

SEQ ID NO: 499 - protein, 18 aa, Artificial Sequence
  ANG2 binding MRD
RISSMVECYFYPNPPHCY

SEQ ID NO: 500 - protein, 18 aa, Artificial Sequence
  ANG2 binding MRD
PFSVITECYFYPNPPHCY

SEQ ID NO: 501 - protein, 18 aa, Artificial Sequence
  ANG2 binding MRD
PSADLLDCYFFPNPPHCS

SEQ ID NO: 502 - protein, 18 aa, Artificial Sequence
  ANG2 binding MRD
QQADHIDCYFYPNPPYCY

SEQ ID NO: 503 - protein, 18 aa, Artificial Sequence
  ANG2 binding MRD
STHDCFLYPNPPHCYWPQ

SEQ ID NO: 504 - protein, 18 aa, Artificial Sequence
  ANG2 binding MRD
VASWKYDCYFYPNPLHCY

SEQ ID NO: 505 - protein, 18 aa, Artificial Sequence
  ANG2 binding MRD
VDIDCYFYPNPPNCYNKA

SEQ ID NO: 506 - protein, 18 aa, Artificial Sequence
  ANG2 binding MRD
LLDRFLDCYFYPNPSHCS

SEQ ID NO: 507 - protein, 18 aa, Artificial Sequence
  ANG2 binding MRD
ECYFYPNPAHCYTGTNKE

SEQ ID NO: 508 - protein, 18 aa, Artificial Sequence
  ANG2 binding MRD
LPHPHLDCYFYPNPAFCY

SEQ ID NO: 509 - protein, 18 aa, Artificial Sequence
  ANG2 binding MRD
SYVDTTDCYFYPNPQHCY

SEQ ID NO: 510 - protein, 18 aa, Artificial Sequence
  ANG2 binding MRD
PPLDCYFYPNPPNCYLGQ

SEQ ID NO: 511 - protein, 18 aa, Artificial Sequence
  ANG2 binding MRD
WINDCYFYPNPSHCFVGD

SEQ ID NO: 512 - protein, 18 aa, Artificial Sequence
  ANG2 binding MRD
YGTDCYFFPNPRNCYKIN

SEQ ID NO: 513 - protein, 18 aa, Artificial Sequence
  ANG2 binding MRD
YSTDCYFYPNPPHCYGPH

SEQ ID NO: 514 - protein, 18 aa, Artificial Sequence
  ANG2 binding MRD
PFSSFFDCYFYPNPHHCY

SEQ ID NO: 515 - protein, 18 aa, Artificial Sequence
  ANG2 binding MRD
YVGHMLDCYFYPNPPHCY

SEQ ID NO: 516 - protein, 18 aa, Artificial Sequence
  ANG2 binding MRD
SMYDCLYFPNPPHCYIQN

SEQ ID NO: 517 - protein, 18 aa, Artificial Sequence
  ANG2 binding MRD
FTQPMVDCYFYPNPPHCY

SEQ ID NO: 518 - protein, 18 aa, Artificial Sequence
  ANG2 binding MRD
FNSTLFDCFFYPNPMHCY

SEQ ID NO: 519 - protein, 18 aa, Artificial Sequence
  ANG2 binding MRD
RSLPIYECYFYPNPPHCY

SEQ ID NO: 520 - protein, 18 aa, Artificial Sequence
  ANG2 binding MRD
VSLYYSACYFYPNPPWCN

SEQ ID NO: 521 - protein, 18 aa, Artificial Sequence
  ANG2 binding MRD
SVLDCYFYPNPAHCYENV

SEQ ID NO: 522 - protein, 18 aa, Artificial Sequence
  ANG2 binding MRD
VSTDCYFYPNPPHCYSVL

SEQ ID NO: 523 - protein, 18 aa, Artificial Sequence
  ANG2 binding MRD
QGTHMLDCYFYPNPPNCY

SEQ ID NO: 524 - protein, 18 aa, Artificial Sequence
  ANG2 binding MRD
TPSDCFFYPNPPHCYLMN

SEQ ID NO: 525 - protein, 18 aa, Artificial Sequence
  ANG2 binding MRD
TWGVCYFYPNPPHCYEQL

SEQ ID NO: 526 - protein, 18 aa, Artificial Sequence
  ANG2 binding MRD
VEEACYFYPNPPHCYEAV

SEQ ID NO: 527 - protein, 18 aa, Artificial Sequence
  ANG2 binding MRD
DDSDCFFYPNPPRCYETY

SEQ ID NO: 528 - protein, 18 aa, Artificial Sequence
  ANG2 binding MRD
YYYSYTHCYYYPNPTHCY

SEQ ID NO: 529 - protein, 18 aa, Artificial Sequence
  ANG2 binding MRD
MTWFPNDCYFYPNPPYCY

SEQ ID NO: 530 - protein, 18 aa, Artificial Sequence
  ANG2 binding MRD
LQLECYYYPNPTHCYETR

SEQ ID NO: 531 - protein, 18 aa, Artificial Sequence
  ANG2 binding MRD
MGISFLDCYFFPNPQHCY

SEQ ID NO: 532 - protein, 18 aa, Artificial Sequence
  ANG2 binding MRD
PSPYYSDCAWYPNPPYCY

SEQ ID NO: 533 - protein, 18 aa, Artificial Sequence
  ANG2 binding MRD
SMSVYIDCFSYPNPPRCY

SEQ ID NO: 534 - protein, 18 aa, Artificial Sequence
  ANG2 binding MRD
DCYFYPNPTHCYLKGGFV

SEQ ID NO: 535 - protein, 18 aa, Artificial Sequence
  ANG2 binding MRD
DHSACYAFPNPSSCYNSR

SEQ ID NO: 536 - protein, 18 aa, Artificial Sequence
  ANG2 binding MRD
PLNACYFYPNPPHCYFLK

SEQ ID NO: 537 - protein, 18 aa, Artificial Sequence
  ANG2 binding MRD
LLSVMQDCYFYPNPSHCY

SEQ ID NO: 538 - protein, 18 aa, Artificial Sequence
  ANG2 binding MRD
PPPSSYECYFYPNPAHCY

SEQ ID NO: 539 - protein, 18 aa, Artificial Sequence
  ANG2 binding MRD
SHTDCYYYPNPPHCYLEN

SEQ ID NO: 540 - protein, 18 aa, Artificial Sequence
  ANG2 binding MRD
AGHECYFYPNPPHCYSEQ

SEQ ID NO: 541 - protein, 18 aa, Artificial Sequence
  ANG2 binding MRD
AGMNDFDCYFFPNPPHCF

SEQ ID NO: 542 - protein, 18 aa, Artificial Sequence
  ANG2 binding MRD
GSRDCYFYPNPKYCYIQD

SEQ ID NO: 543 - protein, 18 aa, Artificial Sequence
  ANG2 binding MRD
SDSFLRDCYFYPNPPHCY

SEQ ID NO: 544 - protein, 18 aa, Artificial Sequence
  ANG2 binding MRD
AWKDCFFYPNPSFCSYSS

SEQ ID NO: 545 - protein, 18 aa, Artificial Sequence
  ANG2 binding MRD
PSLYELDCYFYPNPPHCY

SEQ ID NO: 546 - protein, 18 aa, Artificial Sequence
  ANG2 binding MRD
YLHSFEDCYFYPNPAHCY

SEQ ID NO: 547 - protein, 18 aa, Artificial Sequence
  ANG2 binding MRD
LTIEHQDCYFYPNPPHCY

SEQ ID NO: 548 - protein, 18 aa, Artificial Sequence
  ANG2 binding MRD
YVMGGDDCYFYPNPPECY

SEQ ID NO: 549 - protein, 18 aa, Artificial Sequence
  ANG2 binding MRD
GNIACYFYPNPPHCYNVH

SEQ ID NO: 550 - protein, 18 aa, Artificial Sequence
  ANG2 binding MRD
SGMECYFFPNPPHCYDLK

SEQ ID NO: 551 - protein, 18 aa, Artificial Sequence
  ANG2 binding MRD
LGLRHYACYLYPNPPHCY

SEQ ID NO: 552 - protein, 18 aa, Artificial Sequence
  ANG2 binding MRD
ARSSQFECYFYPNPPHCY

SEQ ID NO: 553 - protein, 18 aa, Artificial Sequence
  ANG2 binding MRD
YPGPFTGCYFYPNPLQCY

SEQ ID NO: 554 - protein, 18 aa, Artificial Sequence
  ANG2 binding MRD
NERDCYFYPNPPHCYQNG

SEQ ID NO: 555 - protein, 18 aa, Artificial Sequence
  ANG2 binding MRD
LDSECFFYPNPPHCYNTL

SEQ ID NO: 556 - protein, 18 aa, Artificial Sequence
  ANG2 binding MRD
PYLDCAEYPNPLYCYESE

SEQ ID NO: 557 - protein, 18 aa, Artificial Sequence
  ANG2 binding MRD
IGYPFSDCYFYPNPPHCY

SEQ ID NO: 558 - protein, 18 aa, Artificial Sequence
  ANG2 binding MRD
WNFDCYFYPNPPLCYNME

SEQ ID NO: 559 - protein, 18 aa, Artificial Sequence
  ANG2 binding MRD
AAVECLFYPNPPHCYERA

SEQ ID NO: 560 - protein, 18 aa, Artificial Sequence
  ANG2 binding MRD
SNVDCYFYPNPPNCFVHD

SEQ ID NO: 561 - protein, 18 aa, Artificial Sequence
  ANG2 binding MRD
VLSFFQDCYFYPNPANCY

SEQ ID NO: 562 - protein, 18 aa, Artificial Sequence
  ANG2 binding MRD
SPPVFWECYFYPNPTHCY

SEQ ID NO: 563 - protein, 18 aa, Artificial Sequence
  ANG2 binding MRD
PNQSNYDCYFYPNPPHCY

SEQ ID NO: 564 - protein, 18 aa, Artificial Sequence
  ANG2 binding MRD
LAFDLSDCYFYPNPPHCS

SEQ ID NO: 565 - protein, 18 aa, Artificial Sequence
  ANG2 binding MRD
FNEECYFYPNPPHCYGEY

SEQ ID NO: 566 - protein, 18 aa, Artificial Sequence
  ANG2 binding MRD
LVVTAFDCYFYPNPPYCY

SEQ ID NO: 567 - protein, 18 aa, Artificial Sequence
  ANG2 binding MRD
SLNPSVDCYFYPNPAHCY

SEQ ID NO: 568 - protein, 17 aa, Artificial Sequence
  ANG2 binding MRD
ALHDCYFYPNPQHCYQA

SEQ ID NO: 569 - protein, 18 aa, Artificial Sequence
  ANG2 binding MRD
FSPGEVDCYFYPNPPHCK

SEQ ID NO: 570 - protein, 18 aa, Artificial Sequence
  ANG2 binding MRD
ADTDCYFYPNPPHCYDIT

SEQ ID NO: 571 - protein, 18 aa, Artificial Sequence
  ANG2 binding MRD
LSLELSECYFFPNPPHCY

SEQ ID NO: 572 - protein, 18 aa, Artificial Sequence
  ANG2 binding MRD
AVLEHFDCYFYPNPPHCY

SEQ ID NO: 573 - protein, 18 aa, Artificial Sequence
  ANG2 binding MRD
MLWDMSGCYFYPNPPHCY

SEQ ID NO: 574 - protein, 18 aa, Artificial Sequence
  ANG2 binding MRD
SKQDCYFYPNPSHCYLDQ

SEQ ID NO: 575 - protein, 18 aa, Artificial Sequence
  ANG2 binding MRD
YDLLLHDCYVFPNPPHCY

SEQ ID NO: 576 - protein, 18 aa, Artificial Sequence
  ANG2 binding MRD
ECYFYPNPPDCFYLHQRR

SEQ ID NO: 577 - protein, 18 aa, Artificial Sequence
  ANG2 binding MRD
DHVECYFYPNPLHCYKDR

SEQ ID NO: 578 - protein, 18 aa, Artificial Sequence
  ANG2 binding MRD
PRPLVIDCYFFPNPPHCY

SEQ ID NO: 579 - protein, 18 aa, Artificial Sequence
  ANG2 binding MRD
DCYFYPNPPHCYIEHKPS

SEQ ID NO: 580 - protein, 18 aa, Artificial Sequence
  ANG2 binding MRD
SHFSFKDCYFYPNPAHCY

SEQ ID NO: 581 - protein, 18 aa, Artificial Sequence
  ANG2 binding MRD
SLRDCYFYPNPAHCRNNM

SEQ ID NO: 582 - protein, 18 aa, Artificial Sequence
  ANG2 binding MRD
YGNECYFFPNPPHCYHRD

SEQ ID NO: 583 - protein, 18 aa, Artificial Sequence
  ANG2 binding MRD
DTLDCYYFPNPPHCYSSQ

SEQ ID NO: 584 - protein, 18 aa, Artificial Sequence
  ANG2 binding MRD
QWNPHYHCFFYPNPPHCY

SEQ ID NO: 585 - protein, 18 aa, Artificial Sequence
  ANG2 binding MRD
TSLDCYFYPNPPHCYETP

SEQ ID NO: 586 - protein, 18 aa, Artificial Sequence
  ANG2 binding MRD
KWARGMECFFYPNPPDCY

SEQ ID NO: 587 - protein, 18 aa, Artificial Sequence
  ANG2 binding MRD
RLVDCYYYPNPLHCYDRS

SEQ ID NO: 588 - protein, 18 aa, Artificial Sequence
  ANG2 binding MRD
THKDCYFFPNPPHCYTKT

SEQ ID NO: 589 - protein, 18 aa, Artificial Sequence
  ANG2 binding MRD
PLKDCYFYPNPLHCYLVS

SEQ ID NO: 590 - protein, 18 aa, Artificial Sequence
  ANG2 binding MRD
APHILQDCYFYPNPRHCY

SEQ ID NO: 591 - protein, 18 aa, Artificial Sequence
  ANG2 binding MRD
LSILYPSCYFYPNPEHCQ

SEQ ID NO: 592 - protein, 18 aa, Artificial Sequence
  ANG2 binding MRD
ECYFYPNPPECYNVDDQA

SEQ ID NO: 593 - protein, 18 aa, Artificial Sequence
  ANG2 binding MRD
ECYFYPNPPHCYVLKQQI

SEQ ID NO: 594 - protein, 18 aa, Artificial Sequence
  ANG2 binding MRD
ISTRNTDCYFYPNPPHCY

SEQ ID NO: 595 - protein, 18 aa, Artificial Sequence
  ANG2 binding MRD
FYYDCFFYPNPPNCYNSF

SEQ ID NO: 596 - protein, 18 aa, Artificial Sequence
  ANG2 binding MRD
FSHLEQDCYFYPNPPHCY

SEQ ID NO: 597 - protein, 18 aa, Artificial Sequence
  ANG2 binding MRD
SPVDCYFYPNPPHCYDWD

SEQ ID NO: 598 - protein, 18 aa, Artificial Sequence
  ANG2 binding MRD
PYQLMTDCYFFPNPPHCY

SEQ ID NO: 599 - protein, 18 aa, Artificial Sequence
  ANG2 binding MRD
ESFQNMDCYFYPNPPYCY

SEQ ID NO: 600 - protein, 18 aa, Artificial Sequence
  ANG2 binding MRD
PRKSFHDCYFYPNPPHCY

SEQ ID NO: 601 - protein, 18 aa, Artificial Sequence
  ANG2 binding MRD
SWPNHMECYFFPNPPHCY

SEQ ID NO: 602 - protein, 18 aa, Artificial Sequence
  ANG2 binding MRD
KSVGNTDCYFFPNPPHCY

SEQ ID NO: 603 - protein, 18 aa, Artificial Sequence
  ANG2 binding MRD
TIYDCYIYPNPRHCYKLN

SEQ ID NO: 604 - protein, 18 aa, Artificial Sequence
  ANG2 binding MRD
ECYFYPNPPHCYHALTSK

SEQ ID NO: 605 - protein, 18 aa, Artificial Sequence
  ANG2 binding MRD
FYQSWVDCYFYPNPPHCS

SEQ ID NO: 606 - protein, 18 aa, Artificial Sequence
  ANG2 binding MRD
YALDLGGCYWFPNPPHCY

SEQ ID NO: 607 - protein, 18 aa, Artificial Sequence
  ANG2 binding MRD
SIFLSLDCYFFPNPSNSL

SEQ ID NO: 608 - protein, 18 aa, Artificial Sequence
  ANG2 binding MRD
GVYSFDQCYVFPNPPDCY

SEQ ID NO: 609 - protein, 18 aa, Artificial Sequence
  ANG2 binding MRD
VVLHYGDCYYYPNPPYCY

SEQ ID NO: 610 - protein, 18 aa, Artificial Sequence
  ANG2 binding MRD
RALDCYFYPNPQHCYQGI

SEQ ID NO: 611 - protein, 18 aa, Artificial Sequence
  ANG2 binding MRD
SPHECYFYPNPPHCYADR

SEQ ID NO: 612 - protein, 18 aa, Artificial Sequence
  ANG2 binding MRD
DVQIEFDCYFYPNPPYCY

SEQ ID NO: 613 - protein, 18 aa, Artificial Sequence
  ANG2 binding MRD
YPMNSHDCYFYPNPPQCY

SEQ ID NO: 614 - protein, 18 aa, Artificial Sequence
  ANG2 binding MRD
SPAHCSYCPFPPNSCFCY

SEQ ID NO: 615 - protein, 18 aa, Artificial Sequence
  ANG2 binding MRD
LRLDLEECYWYPNPPYCK

SEQ ID NO: 616 - protein, 18 aa, Artificial Sequence
  ANG2 binding MRD
GSALLSDCYFYPNPPHCY

SEQ ID NO: 617 - protein, 18 aa, Artificial Sequence
  ANG2 binding MRD
SVLALEDCYFYPNPHHCY

SEQ ID NO: 618 - protein, 18 aa, Artificial Sequence
  ANG2 binding MRD
PTAVLMECYFYPNPDYCY

SEQ ID NO: 619 - protein, 18 aa, Artificial Sequence
  ANG2 binding MRD
YGTECYFYPNPAHCYSNE

SEQ ID NO: 620 - protein, 18 aa, Artificial Sequence
  ANG2 binding MRD
HWYFCPNPPNPPQCHLKW

SEQ ID NO: 621 - protein, 12 aa, Artificial sequence
  ANG100
DCFWYPNPEWCY

SEQ ID NO: 622 - protein, 12 aa, Artificial sequence
  ANG99
KCPLLPDWASCH

SEQ ID NO: 623 - protein, 12 aa, Artificial sequence
  ANG53
TCQDYPFWRYCH

SEQ ID NO: 624 - protein, 12 aa, Artificial sequence
  ANG57
DCYFYPNPPHCY

SEQ ID NO: 625 - protein, 18 aa, Artificial sequence
  ANG318
PHEECYFYPNPPHCYTMS

SEQ ID NO: 626 - protein, 18 aa, Artificial sequence
  ANG202
DCAVYPNPPWCYKMEFGK

SEQ ID NO: 627 - protein, 18 aa, Artificial sequence
  ANG205
RPILCPLLPDWISCHEWL

SEQ ID NO: 628 - protein, 18 aa, Artificial sequence
  ANG200
LWDDCYFFPNPPHCYNSP

SEQ ID NO: 629 - protein, 11 aa, Artificial Sequence
  VEGF binding MRD
WCWVPGPIQCY

SEQ ID NO: 630 - protein, 11 aa, Artificial Sequence
  VEGF binding MRD
CMWEMPWWFCQ

SEQ ID NO: 631 - protein, 12 aa, Artificial Sequence
  VEGF binding MRD
TCTWVMPWWFCE

SEQ ID NO: 632 - protein, 12 aa, Artificial Sequence
  VEGF binding MRD
ICLWQMPWWFCE

SEQ ID NO: 633 - protein, 11 aa, Artificial Sequence
  VEGF binding MRD
GDWEWVWDWCF

SEQ ID NO: 634 - protein, 12 aa, Artificial Sequence
  VEGF binding MRD
ECRWVMPWWFCE

SEQ ID NO: 635 - protein, 12 aa, Artificial Sequence
  VEGF binding MRD
ACWKAMPWWFCT

SEQ ID NO: 636 - protein, 12 aa, Artificial Sequence
  VEGF binding MRD
FCMVQVPWWLCK

SEQ ID NO: 637 - protein, 10 aa, Artificial Sequence
  VEGF binding MRD
FYQWFEEQLM

SEQ ID NO: 638 - protein, 12 aa, Artificial Sequence
  VEGF binding MRD
MCWLVPGPMICH

SEQ ID NO: 639 - protein, 12 aa, Artificial Sequence
  VEGF binding MRD
FCMYKPLMFLCP

SEQ ID NO: 640 - protein, 12 aa, Artificial Sequence
  VEGF binding MRD
HCWWLYTWDPCI

SEQ ID NO: 641 - protein, 12 aa, Artificial Sequence
  VEGF binding MRD
HCYVYVPWWLCP

SEQ ID NO: 642 - protein, 12 aa, Artificial Sequence
  VEGF binding MRD
MCWTPVPWWLCL

SEQ ID NO: 643 - protein, 12 aa, Artificial Sequence
  VEGF binding MRD
TCWKPTPWWLCD

SEQ ID NO: 644 - protein, 12 aa, Artificial Sequence
  VEGF binding MRD
SCWFKIPWWLCP

SEQ ID NO: 645 - protein, 12 aa, Artificial Sequence
  VEGF binding MRD
YCQPMWWNMACW

SEQ ID NO: 646 - protein, 12 aa, Artificial Sequence
  VEGF binding MRD
YCFWIPPEWYCV

SEQ ID NO: 647 - protein, 12 aa, Artificial Sequence
  VEGF binding MRD
GCWEWRPHWLCV

SEQ ID NO: 648 - protein, 11 aa, Artificial Sequence
  VEGF binding MRD
ECTWTMPWWFC

SEQ ID NO: 649 - protein, 12 aa, Artificial Sequence
  VEGF binding MRD
TCWKPAPWWLCA

SEQ ID NO: 650 - protein, 12 aa, Artificial Sequence
  VEGF binding MRD
TCWKPTPWWLCA

SEQ ID NO: 651 - protein, 12 aa, Artificial Sequence
  VEGF binding MRD
KCNFNPWKAACG

SEQ ID NO: 652 - protein, 12 aa, Artificial Sequence
  VEGF binding MRD
TCWKPAPWWLCD

SEQ ID NO: 653 - protein, 12 aa, Artificial Sequence
  VEGF binding MRD
TSWKAAAWGLCA

SEQ ID NO: 654 - protein, 12 aa, Artificial Sequence
  VEGF binding MRD
ACWKATPWWLCD

SEQ ID NO: 655 - protein, 12 aa, Artificial Sequence
  VEGF binding MRD
TCWKATPWWLCA

SEQ ID NO: 656 - protein, 12 aa, Artificial Sequence
  VEGF binding MRD
ACWKAAPWWLCD

SEQ ID NO: 657 - protein, 12 aa, Artificial Sequence
  VEGF binding MRD
TCWKAAPWWLCD

SEQ ID NO: 658 - protein, 12 aa, Artificial Sequence
  VEGF binding MRD
ACWKPAPWWLCD

SEQ ID NO: 659 - protein, 12 aa, Artificial Sequence
  VEGF binding MRD
TCWKATPWWLCD

SEQ ID NO: 660 - protein, 12 aa, Artificial Sequence
  VEGF binding MRD
TCWKAAPWWLCA

SEQ ID NO: 661 - protein, 12 aa, Artificial Sequence
  VEGF binding MRD
ACWKAAPWWLCA

SEQ ID NO: 662 - protein, 12 aa, Artificial Sequence
  VEGF binding MRD
WCAGFPPNYPCY

SEQ ID NO: 663 - protein, 12 aa, Artificial Sequence
  VEGF binding MRD
WCNGFPPNYPCS

SEQ ID NO: 664 - protein, 12 aa, Artificial Sequence
  VEGF binding MRD
WCNGFPPNYPCY

SEQ ID NO: 665 - protein, 12 aa, Artificial Sequence
  VEGF binding MRD
WCNGFPPNYPCA

SEQ ID NO: 666 - protein, 12 aa, Artificial Sequence
  VEGF binding MRD
GCVKEVPWWLCI

SEQ ID NO: 667 - protein, 12 aa, Artificial Sequence
  VEGF binding MRD
GCVKQVPWWLCV

SEQ ID NO: 668 - protein, 12 aa, Artificial Sequence
  VEGF binding MRD
GCVTQVPWWLCI

SEQ ID NO: 669 - protein, 12 aa, Artificial Sequence
  VEGF binding MRD
ACVKEVPWWLCI

SEQ ID NO: 670 - protein, 12 aa, Artificial Sequence
  VEGF binding MRD
GCVKQVPWWLCI

SEQ ID NO: 671 - protein, 12 aa, Artificial Sequence
  VEGF binding MRD
ACVAEVPWWLCI

SEQ ID NO: 672 - protein, 12 aa, Artificial Sequence
  VEGF binding MRD
GCVKAAPWWLCV

SEQ ID NO: 673 - protein, 12 aa, Artificial Sequence
  VEGF binding MRD
GCVKEVPWWLCV

SEQ ID NO: 674 - protein, 12 aa, Artificial Sequence
  VEGF binding MRD
GCVKPAPWWLCI

SEQ ID NO: 675 - protein, 12 aa, Artificial Sequence
  VEGF binding MRD
GCVTEVPWWLCI

SEQ ID NO: 676 - protein, 12 aa, Artificial Sequence
  VEGF binding MRD
GCVAQVPWWLCI

SEQ ID NO: 677 - protein, 12 aa, Artificial Sequence
  VEGF binding MRD
ACVKEAPWWLCI

SEQ ID NO: 678 - protein, 12 aa, Artificial Sequence
  VEGF binding MRD
GCVAEVPWWLCI

SEQ ID NO: 679 - protein, 12 aa, Artificial Sequence
  VEGF binding MRD
ACVKQVPWWLCI

SEQ ID NO: 680 - protein, 12 aa, Artificial Sequence
  VEGF binding MRD
GCVKPAPWWLCV

SEQ ID NO: 681 - protein, 12 aa, Artificial Sequence
  VEGF binding MRD
GCVAEVPWWLCT

SEQ ID NO: 682 - protein, 12 aa, Artificial Sequence
  VEGF binding MRD
GGVKQVASWLGT

SEQ ID NO: 683 - protein, 12 aa, Artificial Sequence
  VEGF binding MRD
GAVTEAAWWLAI

SEQ ID NO: 684 - protein, 12 aa, Artificial Sequence
  VEGF binding MRD
GGVEAAAWWVGI

SEQ ID NO: 685 - protein, 12 aa, Artificial Sequence
  VEGF binding MRD
GCVKQVPWGLCI

SEQ ID NO: 686 - protein, 19 aa, Artificial Sequence
  VEGF binding MRD
VEPNCDIHVMWEWECFERL

SEQ ID NO: 687 - protein, 12 aa, Artificial Sequence
  VEGF binding MRD
WCAGFPPTSAGY

SEQ ID NO: 688 - protein, 12 aa, Artificial Sequence
  VEGF binding MRD
TAWEAAASWLCA

SEQ ID NO: 689 - protein, 12 aa, Artificial Sequence
  VEGF binding MRD
TCGKAAAAWLAA

SEQ ID NO: 690 - protein, 12 aa, Artificial Sequence
  VEGF binding MRD
TGWKPTAWGVGD

SEQ ID NO: 691 - protein, 12 aa, Artificial Sequence
  VEGF binding MRD
ASWKPAPWWLCA

SEQ ID NO: 692 - protein, 12 aa, Artificial Sequence
  VEGF binding MRD
TSGKATPGGACD

SEQ ID NO: 693 - protein, 12 aa, Artificial sequence
  VGF5
ACVKQVPWWLCI

SEQ ID NO: 694 - protein, 12 aa, Artificial sequence
  VGF26
TCWKPTPWWLCD

SEQ ID NO: 695 - protein, 12 aa, Artificial sequence
  VGF57
WCNGFPPNYPCY

SEQ ID NO: 696 - protein, 12 aa, Artificial sequence
  VGF61
GCVKEAPWWLCV

SEQ ID NO: 697 - protein, 12 aa, Artificial sequence
  VGF50
WCNGFPANYPCY

SEQ ID NO: 698 - protein, 10 aa, Artificial Sequence
  IGF1R binding MRD
DSGFYMGLHK

SEQ ID NO: 699 - protein, 10 aa, Artificial Sequence
  IGF1R binding MRD
MDQFHWALLG

SEQ ID NO: 700 - protein, 10 aa, Artificial Sequence
  IGF1R binding MRD
LCQEFHELCF

SEQ ID NO: 701 - protein, 10 aa, Artificial Sequence
  IGF1R binding MRD
LCDEFVELCF

SEQ ID NO: 702 - protein, 10 aa, Artificial Sequence
  IGF1R binding MRD
LCEEFHELCF

SEQ ID NO: 703 - protein, 10 aa, Artificial Sequence
  IGF1R binding MRD
LCDEFKELCF

SEQ ID NO: 704 - protein, 10 aa, Artificial Sequence
  IGF1R binding MRD
LCAEFPELCF

SEQ ID NO: 705 - protein, 32 aa, Artificial Sequence
  IGF1R binding MRD
ICHIFWQTCNGQAGQGGGSGGSKCDILEMMCN

SEQ ID NO: 706 - protein, 10 aa, Artificial Sequence
  IGF1R binding MRD
LCMEFPELCF

SEQ ID NO: 707 - protein, 10 aa, Artificial Sequence
  IGF1R binding MRD
LCMEFKELCF

SEQ ID NO: 708 - protein, 10 aa, Artificial Sequence
  IGF1R binding MRD
LCEEFPVLCF

SEQ ID NO: 709 - protein, 10 aa, Artificial Sequence
  IGF1R binding MRD
LCQEFIELCF

SEQ ID NO: 710 - protein, 10 aa, Artificial Sequence
  IGF1R binding MRD
LCLEFHELCF

SEQ ID NO: 711 - protein, 10 aa, Artificial Sequence
  IGF1R binding MRD
LCQEFSELCF

SEQ ID NO: 712 - protein, 10 aa, Artificial Sequence
  IGF1R binding MRD
LCEEFAELCF

SEQ ID NO: 713 - protein, 10 aa, Artificial Sequence
  IGF1R binding MRD
LCFEFVELCF

SEQ ID NO: 714 - protein, 10 aa, Artificial Sequence
  IGF1R binding MRD
LCSEFQVLCF

SEQ ID NO: 715 - protein, 10 aa, Artificial Sequence
  IGF1R binding MRD
LCLEFVELCF

SEQ ID NO: 716 - protein, 10 aa, Artificial Sequence
  IGF1R binding MRD
LCWEFPVLCF

SEQ ID NO: 717 - protein, 10 aa, Artificial Sequence
  IGF1R binding MRD
LCEEFIELCF

SEQ ID NO: 718 - protein, 32 aa, Artificial Sequence
  IGF1R binding MRD
WCEISTTFCNGQAGQGGGGGGSQCQLLHMFCH

SEQ ID NO: 719 - protein, 10 aa, Artificial Sequence
  IGF1R binding MRD
LCMEFEQLCF

SEQ ID NO: 720 - protein, 10 aa, Artificial Sequence
  IGF1R binding MRD
LCLEFRELCF

SEQ ID NO: 721 - protein, 10 aa, Artificial Sequence
  IGF1R binding MRD
LCQEFAELCF

SEQ ID NO: 722 - protein, 10 aa, Artificial Sequence
  IGF1R binding MRD
LCQEFKELCF

SEQ ID NO: 723 - protein, 10 aa, Artificial Sequence
  IGF1R binding MRD
LCLEFEELCF

SEQ ID NO: 724 - protein, 10 aa, Artificial Sequence
  IGF1R binding MRD
LCYEFEELCF

SEQ ID NO: 725 - protein, 10 aa, Artificial Sequence
  IGF1R binding MRD
LCMEFQELCF

SEQ ID NO: 726 - protein, 10 aa, Artificial Sequence
  IGF1R binding MRD
LCHEFEELCF

SEQ ID NO: 727 - protein, 10 aa, Artificial Sequence
  IGF1R binding MRD
LCYEFHELCF

SEQ ID NO: 728 - protein, 10 aa, Artificial Sequence
  IGF1R binding MRD
LCDEFQELCF

SEQ ID NO: 729 - protein, 34 aa, Artificial Sequence
  IGF1R binding MRD
WCQIQAFHCRGQAGQGGGSAGGGSSCNILQLMCS

SEQ ID NO: 730 - protein, 11 aa, Artificial Sequence
  IGF1R binding MRD
FECVLWNFVCK

SEQ ID NO: 731 - protein, 10 aa, Artificial Sequence
  IGF1R binding MRD
LCAEFPVLCF

SEQ ID NO: 732 - protein, 10 aa, Artificial Sequence
  IGF1R binding MRD
LCTEFKELCF

SEQ ID NO: 733 - protein, 10 aa, Artificial Sequence
  IGF1R binding MRD
LCQEFNELCF

SEQ ID NO: 734 - protein, 27 aa, Artificial Sequence
  IGF1R binding MRD
AMTLDEWIRMRGQAGGSWVDPAFWGDF

SEQ ID NO: 735 - protein, 10 aa, Artificial Sequence
  IGF1R binding MRD
FYGWFEEQIL

SEQ ID NO: 736 - protein, 10 aa, Artificial Sequence
  IGF1R binding MRD
FYEQLEKLVY

SEQ ID NO: 737 - protein, 10 aa, Artificial Sequence
  IGF1R binding MRD
FYEWFEEQLI

SEQ ID NO: 738 - protein, 10 aa, Artificial Sequence
  IGF1R binding MRD
FYEWFEAQIM

SEQ ID NO: 739 - protein, 10 aa, Artificial Sequence
  IGF1R binding MRD
FYDWFDMHVK

SEQ ID NO: 740 - protein, 36 aa, Artificial Sequence
  IGF1R binding MRD
SFYDMIELLIGQAGQGGGSGGGGGGSTIHFAQEEHP

SEQ ID NO: 741 - protein, 10 aa, Artificial Sequence
  IGF1R binding MRD
FYEWFEAQVM

SEQ ID NO: 742 - protein, 10 aa, Artificial Sequence
  IGF1R binding MRD
FYDWFAEQVI

SEQ ID NO: 743 - protein, 10 aa, Artificial Sequence
  IGF1R binding MRD
FYEWFTEQVN

SEQ ID NO: 744 - protein, 10 aa, Artificial Sequence
  IGF1R binding MRD
FYEWFHEQVI

SEQ ID NO: 745 - protein, 10 aa, Artificial Sequence
  IGF1R binding MRD
QFYEWFEAQT

SEQ ID NO: 746 - protein, 10 aa, Artificial Sequence
  IGF1R binding MRD
FYEWFQLQMD

SEQ ID NO: 747 - protein, 10 aa, Artificial Sequence
  IGF1R binding MRD
VHWEGYQWVY

SEQ ID NO: 748 - protein, 10 aa, Artificial Sequence
  IGF1R binding MRD
FYETLFELAY

SEQ ID NO: 749 - protein, 10 aa, Artificial Sequence
  IGF1R binding MRD
FYEWFEAALI

SEQ ID NO: 750 - protein, 10 aa, Artificial Sequence
  IGF1R binding MRD
FYDWFDMQVQ

SEQ ID NO: 751 - protein, 10 aa, Artificial Sequence
  IGF1R binding MRD
FYEWFEPQVT

SEQ ID NO: 752 - protein, 10 aa, Artificial Sequence
  IGF1R binding MRD
EFYYWFFDQY

SEQ ID NO: 753 - protein, 10 aa, Artificial Sequence
  IGF1R binding MRD
FYEWFDMQVK

SEQ ID NO: 754 - protein, 11 aa, Artificial Sequence
  IGF1R binding MRD
ADFYQWFQNQV

SEQ ID NO: 755 - protein, 10 aa, Artificial Sequence
  IGF1R binding MRD
SFYAWFDEQV

SEQ ID NO: 756 - protein, 10 aa, Artificial Sequence
  IGF1R binding MRD
EVWEGYDWLY

SEQ ID NO: 757 - protein, 16 aa, Artificial Sequence
  IGF1R binding MRD
SHPLCTEFIELCFGFE

SEQ ID NO: 758 - protein, 16 aa, Artificial Sequence
  IGF1R binding MRD
VPFLCLEFSELCFTDP

SEQ ID NO: 759 - protein, 16 aa, Artificial Sequence
  IGF1R binding MRD
ADLLCAEFTELCFDVI

SEQ ID NO: 760 - protein, 16 aa, Artificial Sequence
  IGF1R binding MRD
AHPLCLEFSELCFEAV

SEQ ID NO: 761 - protein, 16 aa, Artificial Sequence
  IGF1R binding MRD
PHPLCQEFEELCFETV

SEQ ID NO: 762 - protein, 16 aa, Artificial Sequence
  IGF1R binding MRD
ASQLCGEFPELCFDKV

SEQ ID NO: 763 - protein, 16 aa, Artificial Sequence
  IGF1R binding MRD
IPLLCFEFVELCFDLT

SEQ ID NO: 764 - protein, 16 aa, Artificial Sequence
  IGF1R binding MRD
DDALCKEFPELCFQNV

SEQ ID NO: 765 - protein, 16 aa, Artificial Sequence
  IGF1R binding MRD
IPYLCLEFPVLCFQDT

SEQ ID NO: 766 - protein, 16 aa, Artificial Sequence
  IGF1R binding MRD
PHILCLEFAELCFDHL

SEQ ID NO: 767 - protein, 16 aa, Artificial Sequence
  IGF1R binding MRD
VPALCLEFKELCFHDR

SEQ ID NO: 768 - protein, 16 aa, Artificial Sequence
  IGF1R binding MRD
TPALCLEFWELCFDEA

SEQ ID NO: 769 - protein, 16 aa, Artificial Sequence
  IGF1R binding MRD
VPPLCMEFTELCFHDP

SEQ ID NO: 770 - protein, 16 aa, Artificial Sequence
  IGF1R binding MRD
AHPLCVEFSELCFNED

SEQ ID NO: 771 - protein, 16 aa, Artificial Sequence
  IGF1R binding MRD
IPMLCWEFTELCFDLN

SEQ ID NO: 772 - protein, 16 aa, Artificial Sequence
  IGF1R binding MRD
VPQLCLEFQELCFGEH

SEQ ID NO: 773 - protein, 16 aa, Artificial Sequence
  IGF1R binding MRD
VPSLCLEFPELCFNEA

SEQ ID NO: 774 - protein, 16 aa, Artificial Sequence
  IGF1R binding MRD
PHPLCLEFIELCFGTH

SEQ ID NO: 775 - protein, 16 aa, Artificial Sequence
  IGF1R binding MRD
IPFLCLEFEELCFHLD

SEQ ID NO: 776 - protein, 16 aa, Artificial Sequence
  IGF1R binding MRD
EHPLCLEFPELCFSHP

SEQ ID NO: 777 - protein, 16 aa, Artificial Sequence
  IGF1R binding MRD
PHYLCLEFSELCFDER

SEQ ID NO: 778 - protein, 16 aa, Artificial Sequence
  IGF1R binding MRD
TPFLCLEFHELCFGEH

SEQ ID NO: 779 - protein, 16 aa, Artificial Sequence
  IGF1R binding MRD
PQLLCLEFAELCFWDI

SEQ ID NO: 780 - protein, 16 aa, Artificial Sequence
  IGF1R binding MRD
PHALCREFHELCFEKS

SEQ ID NO: 781 - protein, 16 aa, Artificial Sequence
  IGF1R binding MRD
RLPLCVEFSELCFDLR

SEQ ID NO: 782 - protein, 16 aa, Artificial Sequence
  IGF1R binding MRD
VPALCWEFPELCFHYQ

SEQ ID NO: 783 - protein, 16 aa, Artificial Sequence
  IGF1R binding MRD
TPSLCLEFSELCFADG

SEQ ID NO: 784 - protein, 16 aa, Artificial Sequence
  IGF1R binding MRD
VHWLCAEFEELCFDQT

SEQ ID NO: 785 - protein, 16 aa, Artificial Sequence
  IGF1R binding MRD
LHFLCLEFQELCFDSN

SEQ ID NO: 786 - protein, 16 aa, Artificial Sequence
  IGF1R binding MRD
VPPLCLEFPELCFTDS

SEQ ID NO: 787 - protein, 16 aa, Artificial Sequence
  IGF1R binding MRD
DHWLCIEFSELCFGKS

SEQ ID NO: 788 - protein, 16 aa, Artificial Sequence
  IGF1R binding MRD
EHPLCEEFKELCFGTN

SEQ ID NO: 789 - protein, 16 aa, Artificial Sequence
  IGF1R binding MRD
DWRLCQEFTELCFMDG

SEQ ID NO: 790 - protein, 16 aa, Artificial Sequence
  IGF1R binding MRD
YLSLCAEFTELCFHTE

SEQ ID NO: 791 - protein, 16 aa, Artificial Sequence
  IGF1R binding MRD
PPLLCFEFPELCFGYE

SEQ ID NO: 792 - protein, 16 aa, Artificial Sequence
  IGF1R binding MRD
DHKLCNEFPELCFHDV

SEQ ID NO: 793 - protein, 16 aa, Artificial Sequence
  IGF1R binding MRD
AHALCLEFLELCFEER

SEQ ID NO: 794 - protein, 16 aa, Artificial Sequence
  IGF1R binding MRD
IPFLCYEFQELCFGTL

SEQ ID NO: 795 - protein, 16 aa, Artificial Sequence
  IGF1R binding MRD
AELLCREFTELCFLRD

SEQ ID NO: 796 - protein, 16 aa, Artificial Sequence
  IGF1R binding MRD
APGLCIEFRELCFDEK

SEQ ID NO: 797 - protein, 16 aa, Artificial Sequence
  IGF1R binding MRD
YYALCAEFQELCFDEH

SEQ ID NO: 798 - protein, 16 aa, Artificial Sequence
  IGF1R binding MRD
VPLLCFEFPELCFGYQ

SEQ ID NO: 799 - protein, 16 aa, Artificial Sequence
  IGF1R binding MRD
VPSLCIEFSELCFDSP

SEQ ID NO: 800 - protein, 16 aa, Artificial Sequence
  IGF1R binding MRD
DYALCLEFRELCFGMN

SEQ ID NO: 801 - protein, 16 aa, Artificial Sequence
  IGF1R binding MRD
AHRLCQEFVELCFGET

SEQ ID NO: 802 - protein, 16 aa, Artificial Sequence
  IGF1R binding MRD
PHFLCMEFPVLCFNDS

SEQ ID NO: 803 - protein, 16 aa, Artificial Sequence
  IGF1R binding MRD
IPQLCLEFSELCFGMT

SEQ ID NO: 804 - protein, 16 aa, Artificial Sequence
  IGF1R binding MRD
RTDLCMEFYELCFHSD

SEQ ID NO: 805 - protein, 16 aa, Artificial Sequence
  IGF1R binding MRD
KPPLCEEFHELCFDLT

SEQ ID NO: 806 - protein, 16 aa, Artificial Sequence
  IGF1R binding MRD
PHKLCLEFRELCFDEL

SEQ ID NO: 807 - protein, 16 aa, Artificial Sequence
  IGF1R binding MRD
LHFLCVEFVELCFDEA

SEQ ID NO: 808 - protein, 16 aa, Artificial Sequence
  IGF1R binding MRD
VPRLCYEFPELCFHKQ

SEQ ID NO: 809 - protein, 16 aa, Artificial Sequence
  IGF1R binding MRD
PHPLCLEFEELCFTER

SEQ ID NO: 810 - protein, 16 aa, Artificial Sequence
  IGF1R binding MRD
AARLCSEFPELCFHAS

SEQ ID NO: 811 - protein, 16 aa, Artificial Sequence
  IGF1R binding MRD
RHSLCIEFPELCFDEY

SEQ ID NO: 812 - protein, 16 aa, Artificial Sequence
  IGF1R binding MRD
AGRLCAEFHELCFGTN

SEQ ID NO: 813 - protein, 16 aa, Artificial Sequence
  IGF1R binding MRD
ASRLCMEFPELCFDRK

SEQ ID NO: 814 - protein, 16 aa, Artificial Sequence
  IGF1R binding MRD
HPALCVEFVELCFGHE

SEQ ID NO: 815 - protein, 16 aa, Artificial Sequence
  IGF1R binding MRD
IPPLCLEFQELCFGWD

SEQ ID NO: 816 - protein, 16 aa, Artificial Sequence
  IGF1R binding MRD
DDALCAEFNELCFEVT

SEQ ID NO: 817 - protein, 16 aa, Artificial Sequence
  IGF1R binding MRD
APPLCIEFEELCFGFL

SEQ ID NO: 818 - protein, 16 aa, Artificial Sequence
  IGF1R binding MRD
SHPLCLEFHELCFTDA

SEQ ID NO: 819 - protein, 16 aa, Artificial Sequence
  IGF1R binding MRD
IHPLCLEFTELCFHEV

SEQ ID NO: 820 - protein, 16 aa, Artificial Sequence
  IGF1R binding MRD
QEPLCVEFRELCFNED

SEQ ID NO: 821 - protein, 16 aa, Artificial Sequence
  IGF1R binding MRD
IPDLCREFEELCFGSK

SEQ ID NO: 822 - protein, 16 aa, Artificial Sequence
  IGF1R binding MRD
IHPLCKEFPELCFDVD

SEQ ID NO: 823 - protein, 16 aa, Artificial Sequence
  IGF1R binding MRD
GPLLCAEFVELCFGDD

SEQ ID NO: 824 - protein, 16 aa, Artificial Sequence
  IGF1R binding MRD
YPPLCLEFPELCFWNH

SEQ ID NO: 825 - protein, 16 aa, Artificial Sequence
  IGF1R binding MRD
SHNLCLEFVELCFGDV

SEQ ID NO: 826 - protein, 16 aa, Artificial Sequence
  IGF1R binding MRD
PPLLCLEFHELCFHIE

SEQ ID NO: 827 - protein, 16 aa, Artificial Sequence
  IGF1R binding MRD
AHVLCLEFHELCFDMG

SEQ ID NO: 828 - protein, 16 aa, Artificial Sequence
  IGF1R binding MRD
RPLLCYEFSELCFDIT

SEQ ID NO: 829 - protein, 16 aa, Artificial Sequence
  IGF1R binding MRD
HPRLCLEFSELCFDEM

SEQ ID NO: 830 - protein, 16 aa, Artificial Sequence
  IGF1R binding MRD
IPALCLEFSELCFSTS

SEQ ID NO: 831 - protein, 16 aa, Artificial Sequence
  IGF1R binding MRD
APSLCLEFIELCFDNM

SEQ ID NO: 832 - protein, 16 aa, Artificial Sequence
  IGF1R binding MRD
PHPLCREFPVLCFDDT

SEQ ID NO: 833 - protein, 16 aa, Artificial Sequence
  IGF1R binding MRD
VHPLCLEFAELCFVNY

SEQ ID NO: 834 - protein, 16 aa, Artificial Sequence
  IGF1R binding MRD
VPSLCMEFPELCFTTE

SEQ ID NO: 835 - protein, 16 aa, Artificial Sequence
  IGF1R binding MRD
VPLLCLEFAELCFHVE

SEQ ID NO: 836 - protein, 16 aa, Artificial Sequence
  IGF1R binding MRD
AMRLCNEFHELCFGVV

SEQ ID NO: 837 - protein, 16 aa, Artificial Sequence
  IGF1R binding MRD
EERLCKEFPELCFMMT

SEQ ID NO: 838 - protein, 16 aa, Artificial Sequence
  IGF1R binding MRD
TPSLCREFTELCFDSD

SEQ ID NO: 839 - protein, 16 aa, Artificial Sequence
  IGF1R binding MRD
VHPLCMEFTELCFHLR

SEQ ID NO: 840 - protein, 16 aa, Artificial Sequence
  IGF1R binding MRD
AGALCKEFPILCFTME

SEQ ID NO: 841 - protein, 16 aa, Artificial Sequence
  IGF1R binding MRD
EHPLCREFSELCFGMG

SEQ ID NO: 842 - protein, 16 aa, Artificial Sequence
  IGF1R binding MRD
SSSLCLEFSELCFHDD

SEQ ID NO: 843 - protein, 16 aa, Artificial Sequence
  IGF1R binding MRD
ALRLCNEFPELCFGGT

SEQ ID NO: 844 - protein, 16 aa, Artificial Sequence
  IGF1R binding MRD
IPLLCLEFPVLCFENE

SEQ ID NO: 845 - protein, 16 aa, Artificial Sequence
  IGF1R binding MRD
APLLCLEFPELCFGWD

SEQ ID NO: 846 - protein, 16 aa, Artificial Sequence
  IGF1R binding MRD
PALLCQEFAELCFDMP

SEQ ID NO: 847 - protein, 16 aa, Artificial Sequence
  IGF1R binding MRD
YLHLCREFTELCFDEG

SEQ ID NO: 848 - protein, 16 aa, Artificial Sequence
  IGF1R binding MRD
AHWLCLEFKELCFGND

SEQ ID NO: 849 - protein, 16 aa, Artificial Sequence
  IGF1R binding MRD
VPSLCFEFEELCFDWS

SEQ ID NO: 850 - protein, 16 aa, Artificial Sequence
  IGF1R binding MRD
VPSLCLEFQELCFTTE

SEQ ID NO: 851 - protein, 16 aa, Artificial Sequence
  IGF1R binding MRD
PHPLCLEFPELCFGAE

SEQ ID NO: 852 - protein, 16 aa, Artificial Sequence
  IGF1R binding MRD
DSRLCAEFPELCFEDV

SEQ ID NO: 853 - protein, 16 aa, Artificial Sequence
  IGF1R binding MRD
AATLCLEFSELCFDMS

SEQ ID NO: 854 - protein, 16 aa, Artificial Sequence
  IGF1R binding MRD
IPHLCKEFPELCFEQR

SEQ ID NO: 855 - protein, 16 aa, Artificial Sequence
  IGF1R binding MRD
SYLLCREFSELCFDKT

SEQ ID NO: 856 - protein, 16 aa, Artificial Sequence
  IGF1R binding MRD
VPYLCLEFAELCFQVD

SEQ ID NO: 857 - protein, 16 aa, Artificial Sequence
  IGF1R binding MRD
VPPLCVEFSELCFDAP

SEQ ID NO: 858 - protein, 16 aa, Artificial Sequence
  IGF1R binding MRD
MELLCFEFSELCFGSH

SEQ ID NO: 859 - protein, 16 aa, Artificial Sequence
  IGF1R binding MRD
TVALCKEFPELCFDIV

SEQ ID NO: 860 - protein, 16 aa, Artificial Sequence
  IGF1R binding MRD
DPYLCLEFEELCFRFV

SEQ ID NO: 861 - protein, 16 aa, Artificial Sequence
  IGF1R binding MRD
TPALCLEFAELCFEDS

SEQ ID NO: 862 - protein, 16 aa, Artificial Sequence
  IGF1R binding MRD
RHPLCVEFPELCFVDY

SEQ ID NO: 863 - protein, 16 aa, Artificial Sequence
  IGF1R binding MRD
VHPLCIEFPALCFDTR

SEQ ID NO: 864 - protein, 16 aa, Artificial Sequence
  IGF1R binding MRD
YLALCYEFRELCFGDQ

SEQ ID NO: 865 - protein, 16 aa, Artificial Sequence
  IGF1R binding MRD
APLLCLEFPELCFEDI

SEQ ID NO: 866 - protein, 16 aa, Artificial Sequence
  IGF1R binding MRD
VHYLCLEFQELCFDEL

SEQ ID NO: 867 - protein, 16 aa, Artificial Sequence
  IGF1R binding MRD
RPSLCLEFRELCFDTL

SEQ ID NO: 868 - protein, 16 aa, Artificial Sequence
  IGF1R binding MRD
APSLCWEFKELCFDSE

SEQ ID NO: 869 - protein, 16 aa, Artificial Sequence
  IGF1R binding MRD
AHALCLEFSELCFDVT

SEQ ID NO: 870 - protein, 16 aa, Artificial Sequence
  IGF1R binding MRD
TQYLCIEFAELCFDTI

SEQ ID NO: 871 - protein, 16 aa, Artificial Sequence
  IGF1R binding MRD
AGALCREFAELCFHNH

SEQ ID NO: 872 - protein, 16 aa, Artificial Sequence
  IGF1R binding MRD
TPPLCFEFPELCFHLS

SEQ ID NO: 873 - protein, 16 aa, Artificial Sequence
  IGF1R binding MRD
SERLCLEFAELCFGHG

SEQ ID NO: 874 - protein, 16 aa, Artificial Sequence
  IGF1R binding MRD
AHWLCLEFPELCFDKL

SEQ ID NO: 875 - protein, 16 aa, Artificial Sequence
  IGF1R binding MRD
DLHLCREFSELCFSSP

SEQ ID NO: 876 - protein, 16 aa, Artificial Sequence
  IGF1R binding MRD
TPSLCLEFPELCFHGT

SEQ ID NO: 877 - protein, 16 aa, Artificial Sequence
  IGF1R binding MRD
APSLCLEFRELCFEDY

SEQ ID NO: 878 - protein, 16 aa, Artificial Sequence
  IGF1R binding MRD
VPSLCLEFADLCFHDI

SEQ ID NO: 879 - protein, 16 aa, Artificial Sequence
  IGF1R binding MRD
MPALCLEFRELCFEDP

SEQ ID NO: 880 - protein, 16 aa, Artificial Sequence
  IGF1R binding MRD
YMRLCYEFSELCFHAS

SEQ ID NO: 881 - protein, 16 aa, Artificial Sequence
  IGF1R binding MRD
APSLCTEFRELCFDII

SEQ ID NO: 882 - protein, 16 aa, Artificial Sequence
  IGF1R binding MRD
VPPLCLEFAELCFYAD

SEQ ID NO: 883 - protein, 16 aa, Artificial Sequence
  IGF1R binding MRD
TPSLCVEFRELCFDDL

SEQ ID NO: 884 - protein, 16 aa, Artificial Sequence
  IGF1R binding MRD
QEALCIEFHELCFEEY

SEQ ID NO: 885 - protein, 16 aa, Artificial Sequence
  IGF1R binding MRD
ADRLCREFSELCFDVV

SEQ ID NO: 886 - protein, 16 aa, Artificial Sequence
  IGF1R binding MRD
AHPLCLEFPVLCFDDE

SEQ ID NO: 887 - protein, 16 aa, Artificial Sequence
  IGF1R binding MRD
RPVLCIEFPELCFNET

SEQ ID NO: 888 - protein, 16 aa, Artificial Sequence
  IGF1R binding MRD
DVKLCQEFPELCFESY

SEQ ID NO: 889 - protein, 16 aa, Artificial Sequence
  IGF1R binding MRD
VPALCFEFAELCFHIE

SEQ ID NO: 890 - protein, 16 aa, Artificial Sequence
  IGF1R binding MRD
AYALCHEFQELCFETT

SEQ ID NO: 891 - protein, 16 aa, Artificial Sequence
  IGF1R binding MRD
AALLCHEFTELCFLEA

SEQ ID NO: 892 - protein, 16 aa, Artificial Sequence
  IGF1R binding MRD
QHLLCIEFNELCFNDV

SEQ ID NO: 893 - protein, 16 aa, Artificial Sequence
  IGF1R binding MRD
IPPLCLEFWELCFDAP

SEQ ID NO: 894 - protein, 16 aa, Artificial Sequence
  IGF1R binding MRD
AHRLCMEFAELCFGNA

SEQ ID NO: 895 - protein, 16 aa, Artificial Sequence
  IGF1R binding MRD
RPSLCQEFVELCFEEA

SEQ ID NO: 896 - protein, 16 aa, Artificial Sequence
  IGF1R binding MRD
PHRLCIEFPELCFDVV

SEQ ID NO: 897 - protein, 16 aa, Artificial Sequence
  IGF1R binding MRD
AQALCLEFMELCFDVR

SEQ ID NO: 898 - protein, 16 aa, Artificial Sequence
  IGF1R binding MRD
ADALCAEFKELCFNIK

SEQ ID NO: 899 - protein, 16 aa, Artificial Sequence
  IGF1R binding MRD
GHKLCTEFIELCFDVN

SEQ ID NO: 900 - protein, 16 aa, Artificial Sequence
  IGF1R binding MRD
DEQLCLEFVELCFEQT

SEQ ID NO: 901 - protein, 16 aa, Artificial Sequence
  IGF1R binding MRD
VYALCREFSELCFYGN

SEQ ID NO: 902 - protein, 16 aa, Artificial Sequence
  IGF1R binding MRD
AGALCAEFPELCFGGT

SEQ ID NO: 903 - protein, 16 aa, Artificial Sequence
  IGF1R binding MRD
PPSLCLEFPELCFHRS

SEQ ID NO: 904 - protein, 16 aa, Artificial Sequence
  IGF1R binding MRD
IPALCIEFSELCFWPS

SEQ ID NO: 905 - protein, 16 aa, Artificial Sequence
  IGF1R binding MRD
VQPLCLEFSELCFDSA

SEQ ID NO: 906 - protein, 16 aa, Artificial Sequence
  IGF1R binding MRD
EHILCQEFSELCFNRD

SEQ ID NO: 907 - protein, 16 aa, Artificial Sequence
  IGF1R binding MRD
VPPLCLEFTELCFIID

SEQ ID NO: 908 - protein, 16 aa, Artificial Sequence
  IGF1R binding MRD
IPPLCLEFWELCFDER

SEQ ID NO: 909 - protein, 16 aa, Artificial Sequence
  IGF1R binding MRD
PHPLCREFPDLCFDHS

SEQ ID NO: 910 - protein, 16 aa, Artificial Sequence
  IGF1R binding MRD
PHWLCEEFEELCFEAI

SEQ ID NO: 911 - protein, 16 aa, Artificial Sequence
  IGF1R binding MRD
DRLLCSEFYELCFDDN

SEQ ID NO: 912 - protein, 16 aa, Artificial Sequence
  IGF1R binding MRD
PAALCLEFSELCFTQQ

SEQ ID NO: 913 - protein, 16 aa, Artificial Sequence
  IGF1R binding MRD
YSSLCLEFSELCFDQM

SEQ ID NO: 914 - protein, 16 aa, Artificial Sequence
  IGF1R binding MRD
RPALCGEFKELCFDGA

SEQ ID NO: 915 - protein, 16 aa, Artificial Sequence
  IGF1R binding MRD
YNALCNEFIELCFHVN

SEQ ID NO: 916 - protein, 16 aa, Artificial Sequence
  IGF1R binding MRD
PHWLCLEFAELCFGSG

SEQ ID NO: 917 - protein, 16 aa, Artificial Sequence
  IGF1R binding MRD
APPLCLEFRELCFGEQ

SEQ ID NO: 918 - protein, 16 aa, Artificial Sequence
  IGF1R binding MRD
IPQLCLEFTDLCFEDT

SEQ ID NO: 919 - protein, 16 aa, Artificial Sequence
  IGF1R binding MRD
VPHLCIEFAELCFEGT

SEQ ID NO: 920 - protein, 16 aa, Artificial Sequence
  IGF1R binding MRD
RMDLCREFTELCFTDS

SEQ ID NO: 921 - protein, 16 aa, Artificial Sequence
  IGF1R binding MRD
AHQLCIEFAELCFNDG

SEQ ID NO: 922 - protein, 16 aa, Artificial Sequence
  IGF1R binding MRD
PPLLCLEFPVLCFDSP

SEQ ID NO: 923 - protein, 16 aa, Artificial Sequence
  IGF1R binding MRD
PHALCLEFSELCFWSL

SEQ ID NO: 924 - protein, 16 aa, Artificial Sequence
  IGF1R binding MRD
VHQLCMEFEELCFGGA

SEQ ID NO: 925 - protein, 16 aa, Artificial Sequence
  IGF1R binding MRD
PHALCLEFHELCFDSN

SEQ ID NO: 926 - protein, 16 aa, Artificial Sequence
  IGF1R binding MRD
YRALCFEFAELCFDEN

SEQ ID NO: 927 - protein, 10 aa, Artificial Sequence
  IGF1R binding MRD
EFYQGLERLV

SEQ ID NO: 928 - protein, 10 aa, Artificial Sequence
  IGF1R binding MRD
YFYWFQEMVM

SEQ ID NO: 929 - protein, 10 aa, Artificial Sequence
  IGF1R binding MRD
FYQWFEKQLM

SEQ ID NO: 930 - protein, 11 aa, Artificial Sequence
  IGF1R binding MRD
QEFYNWFALQI

SEQ ID NO: 931 - protein, 11 aa, Artificial Sequence
  IGF1R binding MRD
ECDFYCGIYTL

SEQ ID NO: 932 - protein, 10 aa, Artificial Sequence
  IGF1R binding MRD
LCREFQELCF

SEQ ID NO: 933 - protein, 10 aa, Artificial Sequence
  IGF1R binding MRD
GFYEWFEMQL

SEQ ID NO: 934 - protein, 10 aa, Artificial Sequence
  IGF1R binding MRD
FYEWFQAQLT

SEQ ID NO: 935 - protein, 10 aa, Artificial Sequence
  IGF1R binding MRD
GFYEWFEMQM

SEQ ID NO: 936 - protein, 16 aa, Artificial Sequence
  IGF1R binding MRD
YLSPDDMCYEFPELCF

SEQ ID NO: 937 - protein, 16 aa, Artificial Sequence
  IGF1R binding MRD
KTSQDMLCWEFEELCF

SEQ ID NO: 938 - protein, 16 aa, Artificial Sequence
  IGF1R binding MRD
QTTPHILCLEFPELCF

SEQ ID NO: 939 - protein, 16 aa, Artificial Sequence
  IGF1R binding MRD
LTSWELLCFEFEELCF

SEQ ID NO: 940 - protein, 16 aa, Artificial Sequence
  IGF1R binding MRD
LVSPEDLCQEFVELCF

SEQ ID NO: 941 - protein, 16 aa, Artificial Sequence
  IGF1R binding MRD
WYVDPPLCFEFPELCF

SEQ ID NO: 942 - protein, 16 aa, Artificial Sequence
  IGF1R binding MRD
LCAEFAELCFEDTVRY

SEQ ID NO: 943 - protein, 23 aa, Artificial Sequence
  IGF1R binding MRD
PGLEIPQLCKEFPELCFTMDDDF

SEQ ID NO: 944 - protein, 16 aa, Artificial Sequence
  IGF1R binding MRD
LCAEFRELCFHLPAQA

SEQ ID NO: 945 - protein, 23 aa, Artificial Sequence
  IGF1R binding MRD
MRVESLQLCKEFPELCFFSHGWT

SEQ ID NO: 946 - protein, 16 aa, Artificial Sequence
  IGF1R binding MRD
RLTPQDLCFEFSELCF

SEQ ID NO: 947 - protein, 16 aa, Artificial Sequence
  IGF1R binding MRD
LSSYDVLCQEFSELCF

SEQ ID NO: 948 - protein, 17 aa, Artificial Sequence
  IGF1R binding MRD
GPMEVHDLCKEFSELCF

SEQ ID NO: 949 - protein, 23 aa, Artificial Sequence
  IGF1R binding MRD
LRPESIALCKEFPELCFEGWKSA

SEQ ID NO: 950 - protein, 23 aa, Artificial Sequence
  IGF1R binding MRD
QSLDIPGLCKEFPELCFEMTGMR

SEQ ID NO: 951 - protein, 16 aa, Artificial Sequence
  IGF1R binding MRD
LCSEFIELCFDQVPLR

SEQ ID NO: 952 - protein, 16 aa, Artificial Sequence
  IGF1R binding MRD
TSSALKLCQEFPELCF

SEQ ID NO: 953 - protein, 16 aa, Artificial Sequence
  IGF1R binding MRD
LSSYMLLCMEFSELCF

SEQ ID NO: 954 - protein, 16 aa, Artificial Sequence
  IGF1R binding MRD
YVIPHPLCLEFSELCF

SEQ ID NO: 955 - protein, 16 aa, Artificial Sequence
  IGF1R binding MRD
DPSVPALCHEFPELCF

SEQ ID NO: 956 - protein, 16 aa, Artificial Sequence
  IGF1R binding MRD
QGWTHPLCLEFQELCF

SEQ ID NO: 957 - protein, 16 aa, Artificial Sequence
  IGF1R binding MRD
FALVPSLCLEFNELCF

SEQ ID NO: 958 - protein, 23 aa, Artificial Sequence
  IGF1R binding MRD
MSSNSIKLCKEFPELCFHIHGKD

SEQ ID NO: 959 - protein, 16 aa, Artificial Sequence
  IGF1R binding MRD
LCLEFRELCFDLSEPH

SEQ ID NO: 960 - protein, 23 aa, Artificial Sequence
  IGF1R binding MRD
MRLESLELCKEFPELCFSTDLTL

SEQ ID NO: 961 - protein, 23 aa, Artificial Sequence
  IGF1R binding MRD
TMLEIPQLCKEFPELCFHDTTVW

SEQ ID NO: 962 - protein, 16 aa, Artificial Sequence
  IGF1R binding MRD
LCQEFKELCFEAEFQA

SEQ ID NO: 963 - protein, 16 aa, Artificial Sequence
  IGF1R binding MRD
KVTPFMLCQEFPELCF

SEQ ID NO: 964 - protein, 16 aa, Artificial Sequence
  IGF1R binding MRD
APGEHWLCLEFQELCF

SEQ ID NO: 965 - protein, 16 aa, Artificial Sequence
  IGF1R binding MRD
VFQMHPLCLEFPELCF

SEQ ID NO: 966 - protein, 16 aa, Artificial Sequence
  IGF1R binding MRD
YEPPHSLCLEFVELCF

SEQ ID NO: 967 - protein, 16 aa, Artificial Sequence
  IGF1R binding MRD
PPIMHPLCLEFAELCF

SEQ ID NO: 968 - protein, 16 aa, Artificial Sequence
  IGF1R binding MRD
LCAEFIELCFDLEPGI

SEQ ID NO: 969 - protein, 16 aa, Artificial Sequence
  IGF1R binding MRD
LSPEFPDLCLYFGLDC

SEQ ID NO: 970 - protein, 23 aa, Artificial Sequence
  IGF1R binding MRD
GSLSVPKLCKEFPELCFDKKMSG

SEQ ID NO: 971 - protein, 23 aa, Artificial Sequence
  IGF1R binding MRD
QRFEPDDLCKEFPELCFNLNMNV

SEQ ID NO: 972 - protein, 16 aa, Artificial Sequence
  IGF1R binding MRD
LCLEFAELCFGWDDNS

SEQ ID NO: 973 - protein, 16 aa, Artificial Sequence
  IGF1R binding MRD
RIYPSELCLEFAELCF

SEQ ID NO: 974 - protein, 16 aa, Artificial Sequence
  IGF1R binding MRD
QSYEHWLCQEFHELCF

SEQ ID NO: 975 - protein, 16 aa, Artificial Sequence
  IGF1R binding MRD
SSPPHWLCLEFEELCF

SEQ ID NO: 976 - protein, 16 aa, Artificial Sequence
  IGF1R binding MRD
RMSEMDLCAEFFELCF

SEQ ID NO: 977 - protein, 16 aa, Artificial Sequence
  IGF1R binding MRD
LCAEFHELCFDISNQE

SEQ ID NO: 978 - protein, 16 aa, Artificial Sequence
  IGF1R binding MRD
LCFEFAELCFDTEFYN

SEQ ID NO: 979 - protein, 25 aa, Artificial Sequence
  IGF1R binding MRD
PRLCKEFPELCFEVPVIGNEEHYSL

SEQ ID NO: 980 - protein, 23 aa, Artificial Sequence
  IGF1R binding MRD
QGSKVLELCKEFPELCFDRANRL

SEQ ID NO: 981 - protein, 16 aa, Artificial Sequence
  IGF1R binding MRD
TLSPHPLCVEFPELCF

SEQ ID NO: 982 - protein, 16 aa, Artificial Sequence
  IGF1R binding MRD
SEWYHPLCVEFSELCF

SEQ ID NO: 983 - protein, 16 aa, Artificial Sequence
  IGF1R binding MRD
SAGEHWLCVEFQELCF

SEQ ID NO: 984 - protein, 16 aa, Artificial Sequence
  IGF1R binding MRD
LSPAELLCLDFPELCF

SEQ ID NO: 985 - protein, 16 aa, Artificial Sequence
  IGF1R binding MRD
LTPAERLCDEFPVLCF

SEQ ID NO: 986 - protein, 16 aa, Artificial Sequence
  IGF1R binding MRD
LCKEFPELCFDERDKK

SEQ ID NO: 987 - protein, 16 aa, Artificial Sequence
  IGF1R binding MRD
LTSADLLCSEFRELCF

SEQ ID NO: 988 - protein, 16 aa, Artificial Sequence
  IGF1R binding MRD
RITPNDLCQEFQELCF

SEQ ID NO: 989 - protein, 16 aa, Artificial Sequence
  IGF1R binding MRD
FAPPHPLCIEFQELCF

SEQ ID NO: 990 - protein, 23 aa, Artificial Sequence
  IGF1R binding MRD
VGKEVFRLCKEFPELCFYPAISQ

SEQ ID NO: 991 - protein, 23 aa, Artificial Sequence
  IGF1R binding MRD
LRFESPQLCKEFPELCFFESNGW

SEQ ID NO: 992 - protein, 23 aa, Artificial Sequence
  IGF1R binding MRD
YRAERPELCKEFPELCFFENDWW

SEQ ID NO: 993 - protein, 16 aa, Artificial Sequence
  IGF1R binding MRD
LCREFIELCFDIETEV

SEQ ID NO: 994 - protein, 16 aa, Artificial Sequence
  IGF1R binding MRD
RTVVPPLCLEFPELCF

SEQ ID NO: 995 - protein, 16 aa, Artificial Sequence
  IGF1R binding MRD
LYTPQSMCAEFTELCF

SEQ ID NO: 996 - protein, 16 aa, Artificial Sequence
  IGF1R binding MRD
GLVQHNLCLEFVELCF

SEQ ID NO: 997 - protein, 16 aa, Artificial Sequence
  IGF1R binding MRD
IDRPPDLCKEFPELCF

SEQ ID NO: 998 - protein, 23 aa, Artificial Sequence
  IGF1R binding MRD
VFLDAPELCKEFSELCFGYSDSL

SEQ ID NO: 999 - protein, 23 aa, Artificial Sequence
  IGF1R binding MRD
RFSESPPLCKEFPELCFWSPPFP

SEQ ID NO: 1000 - protein, 16 aa, Artificial Sequence
  IGF1R binding MRD
RDFTYDTDWEGYSWLY

SEQ ID NO: 1001 - protein, 16 aa, Artificial Sequence
  IGF1R binding MRD
IPGLCLEFPELCFHQW

SEQ ID NO: 1002 - protein, 10 aa, Artificial Sequence
  IGF1R binding MRD
EPWEGYSWLY

SEQ ID NO: 1003 - protein, 16 aa, Artificial Sequence
  IGF1R binding MRD
PLWEGYSWLYSQEAGN

SEQ ID NO: 1004 - protein, 16 aa, Artificial Sequence
  IGF1R binding MRD
FASGEYPPWEGYRWLY

SEQ ID NO: 1005 - protein, 16 aa, Artificial Sequence
  IGF1R binding MRD
WGDDHWEGYDWLYAQT

SEQ ID NO: 1006 - protein, 16 aa, Artificial Sequence
  IGF1R binding MRD
RDEAEWEGYNWLYSQM

SEQ ID NO: 1007 - protein, 16 aa, Artificial Sequence
  IGF1R binding MRD
DTWEGYLWLYAQTADA

SEQ ID NO: 1008 - protein, 16 aa, Artificial Sequence
  IGF1R binding MRD
YTRSLGDPWEGYSWLY

SEQ ID NO: 1009 - protein, 16 aa, Artificial Sequence
  IGF1R binding MRD
SAWEGYAWFDLQVESG

SEQ ID NO: 1010 - protein, 16 aa, Artificial Sequence
  IGF1R binding MRD
YSIQDHGAWPGYDWLY

SEQ ID NO: 1011 - protein, 16 aa, Artificial Sequence
  IGF1R binding MRD
QWGHKSEQWEGYSWLY

SEQ ID NO: 1012 - protein, 16 aa, Artificial Sequence
  IGF1R binding MRD
QQPNTWEGYSWLYSQV

SEQ ID NO: 1013 - protein, 16 aa, Artificial Sequence
  IGF1R binding MRD
DLWEGYLWFDSQVLGD

SEQ ID NO: 1014 - protein, 16 aa, Artificial Sequence
  IGF1R binding MRD
IPLLCLEFPVLCFENE

SEQ ID NO: 1015 - protein, 16 aa, Artificial Sequence
  IGF1R binding MRD
SYDYSQGEWEGYQWLY

SEQ ID NO: 1016 - protein, 16 aa, Artificial Sequence
  IGF1R binding MRD
HDSALMAEWEGYNWLY

SEQ ID NO: 1017 - protein, 13 aa, Artificial Sequence
  IGF1R binding MRD
QPWEGYKWLYEAA

SEQ ID NO: 1018 - protein, 16 aa, Artificial Sequence
  IGF1R binding MRD
PAASAWEGYKWLYDQV

SEQ ID NO: 1019 - protein, 16 aa, Artificial Sequence
  IGF1R binding MRD
LSTDWSGDWEGYAWLY

SEQ ID NO: 1020 - protein, 16 aa, Artificial Sequence
  IGF1R binding MRD
LLASEWEGYEWLYGQI

SEQ ID NO: 1021 - protein, 17 aa, Artificial Sequence
  IGF1R binding MRD
ALPECQDLMFYECLFTL

SEQ ID NO: 1022 - protein, 19 aa, Artificial Sequence
  IGF1R binding MRD
FYNTCQFVGMEFYQCLDWL

SEQ ID NO: 1023 - protein, 20 aa, Artificial Sequence
  IGF1R binding MRD
RDPVCETKDVFYQMLCTVAF

SEQ ID NO: 1024 - protein, 20 aa, Artificial Sequence
  IGF1R binding MRD
RSLVCSEEEPFYLALCRLTH

SEQ ID NO: 1025 - protein, 17 aa, Artificial Sequence
  IGF1R binding MRD
SVLGCDDVGFYQCLEFL

SEQ ID NO: 1026 - protein, 20 aa, Artificial Sequence
  IGF1R binding MRD
LEHLCQTRDGFYELMCTLAL

SEQ ID NO: 1027 - protein, 19 aa, Artificial Sequence
  IGF1R binding MRD
AARWCDMQQHSFYECLQVL

SEQ ID NO: 1028 - protein, 19 aa, Artificial Sequence
  IGF1R binding MRD
NALGCQEEWETLDQCLMRL

SEQ ID NO: 1029 - protein, 20 aa, Artificial Sequence
  IGF1R binding MRD
AVPKCPGWDFYTALECLSRT

SEQ ID NO: 1030 - protein, 18 aa, Artificial Sequence
  IGF1R binding MRD
EPRLCHNYPDFYQCMSFL

SEQ ID NO: 1031 - protein, 20 aa, Artificial Sequence
  IGF1R binding MRD
ASQTCIGMDFYSGLECLLGW

SEQ ID NO: 1032 - protein, 19 aa, Artificial Sequence
  IGF1R binding MRD
WVEECHNLHWDLKHCLMHQ

SEQ ID NO: 1033 - protein, 19 aa, Artificial Sequence
  IGF1R binding MRD
SVPSCIDYYGDWFLCLAAP

SEQ ID NO: 1034 - protein, 18 aa, Artificial Sequence
  IGF1R binding MRD
NNTLCRGVPTFEECVFIL

SEQ ID NO: 1035 - protein, 20 aa, Artificial Sequence
  IGF1R binding MRD
SNGSCHIVDFYGWFQCQTSA

SEQ ID NO: 1036 - protein, 20 aa, Artificial Sequence
  IGF1R binding MRD
LTEPCSQHSMFYSMLCELAF

SEQ ID NO: 1037 - protein, 21 aa, Artificial Sequence
  IGF1R binding MRD
RDRVCHNKTFFHCLFSIFPDG

SEQ ID NO: 1038 - protein, 17 aa, Artificial Sequence
  IGF1R binding MRD
YGLGCSQMDFYQCLDML

SEQ ID NO: 1039 - protein, 19 aa, Artificial Sequence
  IGF1R binding MRD
DVSHCHIMFWDFQQCLEYL

SEQ ID NO: 1040 - protein, 19 aa, Artificial Sequence
  IGF1R binding MRD
NPATCYQKSYQFEQCLMYL

SEQ ID NO: 1041 - protein, 17 aa, Artificial Sequence
  IGF1R binding MRD
VDVLCHHVDFYECMDRL

SEQ ID NO: 1042 - protein, 21 aa, Artificial Sequence
  IGF1R binding MRD
WLSQCEAKEIDFYMCLAGQAG

SEQ ID NO: 1043 - protein, 18 aa, Artificial Sequence
  IGF1R binding MRD
GPKECIGVPNFDLCMAML

SEQ ID NO: 1044 - protein, 17 aa, Artificial Sequence
  IGF1R binding MRD
LEDWCLHLDFYQCLEAV

SEQ ID NO: 1045 - protein, 17 aa, Artificial Sequence
  IGF1R binding MRD
TMPTCEKLNFYECMNLL

SEQ ID NO: 1046 - protein, 17 aa, Artificial Sequence
  IGF1R binding MRD
SLSICTYADFYECMDLL

SEQ ID NO: 1047 - protein, 21 aa, Artificial Sequence
  IGF1R binding MRD
YIRECHELQNFTEGIHCLVTR

SEQ ID NO: 1048 - protein, 18 aa, Artificial Sequence
  IGF1R binding MRD
TFKDCAHIPGIDFCLWRL

SEQ ID NO: 1049 - protein, 20 aa, Artificial Sequence
  IGF1R binding MRD
SWDPCFESDEFHMKLCVLMD

SEQ ID NO: 1050 - protein, 17 aa, Artificial Sequence
  IGF1R binding MRD
LLSECYDKDFYECLGLL

SEQ ID NO: 1051 - protein, 17 aa, Artificial Sequence
  IGF1R binding MRD
YQDMCEDMSFYECLEVL

SEQ ID NO: 1052 - protein, 20 aa, Artificial Sequence
  IGF1R binding MRD
AAANCHWPDEALQELCRYFA

SEQ ID NO: 1053 - protein, 19 aa, Artificial Sequence
  IGF1R binding MRD
TGICENPDEFYRQLCLLVE

SEQ ID NO: 1054 - protein, 19 aa, Artificial Sequence
  IGF1R binding MRD
WEHHCRRSHLDFYGCLSSI

SEQ ID NO: 1055 - protein, 24 aa, Artificial Sequence
  IGF1R binding MRD
AAGSPLDDCYGYTGFYQGMCLLEL

SEQ ID NO: 1056 - protein, 19 aa, Artificial Sequence
  IGF1R binding MRD
PSYHCSNMDYTFYECLMYL

SEQ ID NO: 1057 - protein, 20 aa, Artificial Sequence
  IGF1R binding MRD
EQSYCSQNDMFYDWFCALVS

SEQ ID NO: 1058 - protein, 20 aa, Artificial Sequence
  IGF1R binding MRD
GEEVCWVQEPFYSTLCILAF

SEQ ID NO: 1059 - protein, 19 aa, Artificial Sequence
  IGF1R binding MRD
NPFWCSWGHQFDNECDSMV

SEQ ID NO: 1060 - protein, 19 aa, Artificial Sequence
  IGF1R binding MRD
WASTCQQTFYSMNRCLSQW

SEQ ID NO: 1061 - protein, 20 aa, Artificial Sequence
  IGF1R binding MRD
LMELCAMDEDYYLWFCRAVE

SEQ ID NO: 1062 - protein, 20 aa, Artificial Sequence
  IGF1R binding MRD
SAVQCDLRLMCWQLRGPSRP

SEQ ID NO: 1063 - protein, 19 aa, Artificial Sequence
  IGF1R binding MRD
PSEICITEGLGFYQCLLKL

SEQ ID NO: 1064 - protein, 19 aa, Artificial Sequence
  IGF1R binding MRD
WVDKCHQEMMEFHECLKYV

SEQ ID NO: 1065 - protein, 19 aa, Artificial Sequence
  IGF1R binding MRD
ARCECWESQFYWDLCSLAL

SEQ ID NO: 1066 - protein, 20 aa, Artificial Sequence
  IGF1R binding MRD
CTATCLEDQGFYWNMCKLVF

SEQ ID NO: 1067 - protein, 18 aa, Artificial Sequence
  IGF1R binding MRD
AYDCRKHHMNFYECLTYL

SEQ ID NO: 1068 - protein, 20 aa, Artificial Sequence
  IGF1R binding MRD
VGQMCSMGLELDRMKCNPCY

SEQ ID NO: 1069 - protein, 19 aa, Artificial Sequence
  IGF1R binding MRD
LVDICQRQELDFYSCLRSV

SEQ ID NO: 1070 - protein, 19 aa, Artificial Sequence
  IGF1R binding MRD
TGSDCYFYKHLYSLCVEVE

SEQ ID NO: 1071 - protein, 20 aa, Artificial Sequence
  IGF1R binding MRD
ESGDCPWLGHVSFEECLMWL

SEQ ID NO: 1072 - protein, 18 aa, Artificial Sequence
  IGF1R binding MRD
LHSVCFEAPEWQQCLMQR

SEQ ID NO: 1073 - protein, 21 aa, Artificial Sequence
  IGF1R binding MRD
PGVSAHALCYEFPVLCFYDVG

SEQ ID NO: 1074 - protein, 21 aa, Artificial Sequence
  IGF1R binding MRD
AGVSADALCYEFPVLCFYDVG

SEQ ID NO: 1075 - protein, 26 aa, Artificial Sequence
  IGF1R binding MRD
DGESYFYVCLEHLLNVPGYHCVMTNG

SEQ ID NO: 1076 - protein, 26 aa, Artificial Sequence
  IGF1R binding MRD
SYGTRWNPSFESNQFHMKLCVLMDGK

SEQ ID NO: 1077 - protein, 20 aa, Artificial Sequence
  IGF1R binding MRD
PGVSADALCYEFPVLCFYDV

SEQ ID NO: 1078 - protein, 15 aa, Artificial Sequence
  IGF1R binding MRD
HALCYEFPVLCFYDV

SEQ ID NO: 1079 - protein, 20 aa, Artificial Sequence
  IGF1R binding MRD
TSRRCEEYQDPLKEVCRYFL

SEQ ID NO: 1080 - protein, 17 aa, Artificial Sequence
  IGF1R binding MRD
AHALCYEFPVLCFYDVG

SEQ ID NO: 1081 - protein, 16 aa, Artificial Sequence
  IGF1R binding MRD
AHALCYEFPVLCFYDV

SEQ ID NO: 1082 - protein, 22 aa, Artificial Sequence
  IGF1R binding MRD
DFYICLEHLLNVPGYHCVMTNG

SEQ ID NO: 1083 - protein, 15 aa, Artificial Sequence
  IGF1R binding MRD
DALCYEFPVLCFYDV

SEQ ID NO: 1084 - protein, 20 aa, Artificial Sequence
  IGF1R binding MRD
NLMECHALDFNQGMQCLQAY

SEQ ID NO: 1085 - protein, 23 aa, Artificial Sequence
  IGF1R binding MRD
NLMECHALDFYQGMQCLQPYRHP

SEQ ID NO: 1086 - protein, 21 aa, Artificial Sequence
  IGF1R binding MRD
DLMECHGLDFYKGMECLQAYG

SEQ ID NO: 1087 - protein, 16 aa, Artificial Sequence
  IGF1R binding MRD
AHALCYEFPVLCFYDV

SEQ ID NO: 1088 - protein, 20 aa, Artificial Sequence
  IGF1R binding MRD
NLMECHALDFNQGMQCVQAY

SEQ ID NO: 1089 - protein, 17 aa, Artificial Sequence
  IGF1R binding MRD
AHALCYEFPVLCFYDVG

SEQ ID NO: 1090 - protein, 26 aa, Artificial Sequence
  IGF1R binding MRD
AYVCSNLNHCPALDFNQGMQCLQAYG

SEQ ID NO: 1091 - protein, 25 aa, Artificial Sequence
  IGF1R binding MRD
VTEARTNDCNTTTFYHWFDCQLGTG

SEQ ID NO: 1092 - protein, 20 aa, Artificial Sequence
  IGF1R binding MRD
NLMHCHGLDFYQGMQCLQAY

SEQ ID NO: 1093 - protein, 20 aa, Artificial Sequence
  IGF1R binding MRD
EAECRYPDTDLMWLCTYFSG

SEQ ID NO: 1094 - protein, 16 aa, Artificial Sequence
  IGF1R binding MRD
DALCYEFPVLCFYDVG

SEQ ID NO: 1095 - protein, 14 aa, Artificial Sequence
  IGF1R binding MRD
MAVGCTWVESCHWA

SEQ ID NO: 1096 - protein, 16 aa, Artificial Sequence
  IGF1R binding MRD
ALPECQDLMFYECLFT

SEQ ID NO: 1097 - protein, 18 aa, Artificial Sequence
  IGF1R binding MRD
FYNTCQFVGMEFYQCLDW

SEQ ID NO: 1098 - protein, 16 aa, Artificial Sequence
  IGF1R binding MRD
SVLGCDDVGFYQCLEF

SEQ ID NO: 1099 - protein, 18 aa, Artificial Sequence
  IGF1R binding MRD
AARWCDMQQHSFYECLQV

SEQ ID NO: 1100 - protein, 17 aa, Artificial Sequence
  IGF1R binding MRD
EPRLCHNYPDFYQCMSF

SEQ ID NO: 1101 - protein, 19 aa, Artificial Sequence
  IGF1R binding MRD
ASQTCIGMDFYSGLECLLG

SEQ ID NO: 1102 - protein, 19 aa, Artificial Sequence
  IGF1R binding MRD
SNGSCHIVDFYGWFQCQTS

SEQ ID NO: 1103 - protein, 18 aa, Artificial Sequence
  IGF1R binding MRD
ALAECIFEPTFEDCMWIL

SEQ ID NO: 1104 - protein, 19 aa, Artificial Sequence
  IGF1R binding MRD
VDMQCQVHGMTFYECLMRL

SEQ ID NO: 1105 - protein, 18 aa, Artificial Sequence
  IGF1R binding MRD
TLPECLYAPTFEICVEYL

SEQ ID NO: 1106 - protein, 19 aa, Artificial Sequence
  IGF1R binding MRD
WEERCVDSDFYTQLCMLAW

SEQ ID NO: 1107 - protein, 18 aa, Artificial Sequence
  IGF1R binding MRD
GTVLCPEDMDFYECMTFI

SEQ ID NO: 1108 - protein, 18 aa, Artificial Sequence
  IGF1R binding MRD
REELCSVSPFDYHCRLFS

SEQ ID NO: 1109 - protein, 19 aa, Artificial Sequence
  IGF1R binding MRD
LSYTCQHFDLPWELCLSLH

SEQ ID NO: 1110 - protein, 17 aa, Artificial Sequence
  IGF1R binding MRD
VISECEGLTFYQCMASL

SEQ ID NO: 1111 - protein, 19 aa, Artificial Sequence
  IGF1R binding MRD
WEEWCVDSDFYTQLCMLAW

SEQ ID NO: 1112 - protein, 20 aa, Artificial Sequence
  IGF1R binding MRD
REPLCIQDDPIMYLHCYFSV

SEQ ID NO: 1113 - protein, 19 aa, Artificial Sequence
  IGF1R binding MRD
MSYTCEDFDLPWELCLSLH

SEQ ID NO: 1114 - protein, 17 aa, Artificial Sequence
  IGF1R binding MRD
DDLDCKCLTFYECMAAL

SEQ ID NO: 1115 - protein, 19 aa, Artificial Sequence
  IGF1R binding MRD
WSNVCQARNMAFQECLEYL

SEQ ID NO: 1116 - protein, 17 aa, Artificial Sequence
  IGF1R binding MRD
EDLGCLYLTFNQCMMWL

SEQ ID NO: 1117 - protein, 19 aa, Artificial Sequence
  IGF1R binding MRD
FAHECSFHKLNFYQCLSFE

SEQ ID NO: 1118 - protein, 16 aa, Artificial Sequence
  IGF1R binding MRD
LMDFCYVYPNICGCSN

SEQ ID NO: 1119 - protein, 18 aa, Artificial Sequence
  IGF1R binding MRD
SRFVCQHDWGFYECLSML

SEQ ID NO: 1120 - protein, 18 aa, Artificial Sequence
  IGF1R binding MRD
ASHICHLIPTIEQCLFSL

SEQ ID NO: 1121 - protein, 17 aa, Artificial Sequence
  IGF1R binding MRD
VISECEGLTFYECMAAL

SEQ ID NO: 1122 - protein, 19 aa, Artificial Sequence
  IGF1R binding MRD
VDMLCQVHGMTFYECLMLL

SEQ ID NO: 1123 - protein, 19 aa, Artificial Sequence
  IGF1R binding MRD
WEEWCVDSDFYTQLCLLAW

SEQ ID NO: 1124 - protein, 19 aa, Artificial Sequence
  IGF1R binding MRD
WDRWCVTEELPEQLCFLDG

SEQ ID NO: 1125 - protein, 19 aa, Artificial Sequence
  IGF1R binding MRD
MSYTCEDFDLPCELCLSLH

SEQ ID NO: 1126 - protein, 19 aa, Artificial Sequence
  IGF1R binding MRD
GLDSCQQAYFYQFFCEVFR

SEQ ID NO: 1127 - protein, 19 aa, Artificial Sequence
  IGF1R binding MRD
VDMQCQVHGMTFYQCLMRL

SEQ ID NO: 1128 - protein, 17 aa, Artificial Sequence
  IGF1R binding MRD
EDLGCMYLTFYECMIWL

SEQ ID NO: 1129 - protein, 17 aa, Artificial Sequence
  IGF1R binding MRD
VSALCEDLEFYECILAL

SEQ ID NO: 1130 - protein, 17 aa, Artificial Sequence
  IGF1R binding MRD
DVRECEGLTFYECMAAL

SEQ ID NO: 1131 - protein, 18 aa, Artificial Sequence
  IGF1R binding MRD
TAWCHAAGLTFTQCLLWL

SEQ ID NO: 1132 - protein, 19 aa, Artificial Sequence
  IGF1R binding MRD
CEEWCVDSDFYTQLCMLAW

SEQ ID NO: 1133 - protein, 17 aa, Artificial Sequence
  IGF1R binding MRD
GISECEGLTFYECMAAL

SEQ ID NO: 1134 - protein, 20 aa, Artificial Sequence
  IGF1R binding MRD
EYKVCTSNDTFHWGICALLK

SEQ ID NO: 1135 - protein, 17 aa, Artificial Sequence
  IGF1R binding MRD
EDLGCMYLTFDECMMWL

SEQ ID NO: 1136 - protein, 19 aa, Artificial Sequence
  IGF1R binding MRD
WKEWCVDSDFYTQLCMLAW

SEQ ID NO: 1137 - protein, 19 aa, Artificial Sequence
  IGF1R binding MRD
FGQLCDQQVETMIECFERL

SEQ ID NO: 1138 - protein, 17 aa, Artificial Sequence
  IGF1R binding MRD
DLFDCQGLTFYQCLAAL

SEQ ID NO: 1139 - protein, 19 aa, Artificial Sequence
  IGF1R binding MRD
LQQICDPEHVTFYQCMTLL

SEQ ID NO: 1140 - protein, 17 aa, Artificial Sequence
  IGF1R binding MRD
QSLTCNDFTDWQSLCRC

SEQ ID NO: 1141 - protein, 20 aa, Artificial Sequence
  IGF1R binding MRD
PREACHDYDVVLHQLCMYFV

SEQ ID NO: 1142 - protein, 17 aa, Artificial Sequence
  IGF1R binding MRD
EDLGCVCLTFYECMIAL

SEQ ID NO: 1143 - protein, 16 aa, Artificial Sequence
  IGF1R binding MRD
IPGLCLEFPELCFHQW

SEQ ID NO: 1144 - protein, 16 aa, Artificial Sequence
  IGF1R binding MRD
LCWEGYKWFYDQIKPD

SEQ ID NO: 1145 - protein, 39 aa, Artificial Sequence
  IGF1R binding MRD
GFHHAYYKYRGQAGQGSATGGSSRITPSDLCKEFPELCF

SEQ ID NO: 1146 - protein, 39 aa, Artificial Sequence
  IGF1R binding MRD
RCLANSYHCSGQAGQGSATGGSSRITPSDLCKEFPELCF

SEQ ID NO: 1147 - protein, 35 aa, Artificial Sequence
  IGF1R binding MRD
GSYCAPDWHNCFGQAGQGSRITPSDLCKEFPELCF

SEQ ID NO: 1148 - protein, 16 aa, Artificial Sequence
  IGF1R binding MRD
IPLLCLEFPVLCFENE

SEQ ID NO: 1149 - protein, 21 aa, Artificial Sequence
  IGF1R binding MRD
SLEHLCQTRDGFYELMCTLAL

SEQ ID NO: 1150 - protein, 21 aa, Artificial Sequence
  IGF1R binding MRD
SKDPVCKTKHQFYQMLCTLAF

SEQ ID NO: 1151 - protein, 10 aa, Artificial sequence
  IGF252
LCKEFPELCF

SEQ ID NO: 1152 - protein, 10 aa, Artificial sequence
  IGF71
QPWEGYSWLY

SEQ ID NO: 1153 - protein, 16 aa, Artificial sequence
  IGF550
RITPSDLCKEFPELCF

SEQ ID NO: 1154 - protein, 39 aa, Artificial sequence; identical to SEQ ID NO: 1145
  IGF2044

SEQ ID NO: 1155 - protein, 46 aa, Artificial sequence
  IGF2037
LCHGYPWYGPCQGQAGQGSATGGSGSTASSRITPSDLCKEFPELCF

SEQ ID NO: 1156 - protein, 43 aa, Artificial sequence
  IGF2039
GSWCDHYPQPVMCLGQAGQGSATGGSSRITPSDLCKEFPELCF

SEQ ID NO: 1157 - protein, 20 aa, Artificial sequence
  IGF2045
TFENALYCLAYGICDKITLI

SEQ ID NO: 1158 - protein, 10 aa, Artificial Sequence
  IL6 binding MRD
QRMEKFMHGS

SEQ ID NO: 1159 - protein, 10 aa, Artificial Sequence
  IL6 binding MRD
MLDWVGRRPF

SEQ ID NO: 1160 - protein, 10 aa, Artificial Sequence
  IL6 binding MRD
YFWHSLKTMM

SEQ ID NO: 1161 - protein, 10 aa, Artificial Sequence
  IL6 binding MRD
DEIPLWEFQF

SEQ ID NO: 1162 - protein, 14 aa, Artificial Sequence
  IL6 binding MRD
FQESWSTWVEGQAG

SEQ ID NO: 1163 - protein, 10 aa, Artificial Sequence
  IL6 binding MRD
VWTAFIQMNS

SEQ ID NO: 1164 - protein, 16 aa, Artificial Sequence
  IL6 binding MRD
ECTHPVFVRPCWGQAG

SEQ ID NO: 1165 - protein, 10 aa, Artificial Sequence
  IL6 binding MRD
MWMYGWWWAG

SEQ ID NO: 1166 - protein, 37 aa, Artificial Sequence
  IL6 binding MRD
FCIYYHNHMIWGQACQAGRCGSYCWWQDYAYKVGQAG

SEQ ID NO: 1167 - protein, 11 aa, Artificial Sequence
  IL6 binding MRD
ICVASICGLVC

SEQ ID NO: 1168 - protein, 14 aa, Artificial Sequence
  IL6 binding MRD
RWHYWHQHWWGQAG

SEQ ID NO: 1169 - protein, 14 aa, Artificial Sequence
  IL6 binding MRD
VCKWKQEYCKGQAG

SEQ ID NO: 1170 - protein, 14 aa, Artificial Sequence
  IL6 binding MRD
WYHWMKEHMWGQAG

SEQ ID NO: 1171 - protein, 20 aa, Artificial Sequence
  IL6 binding MRD
HHHKMWPQNKSADSHAYTMM

SEQ ID NO: 1172 - protein, 10 aa, Artificial Sequence
  IL6 binding MRD
WPSWTYWYHF

SEQ ID NO: 1173 - protein, 10 aa, Artificial Sequence
  IL6 binding MRD
PWTYNWPWFM

SEQ ID NO: 1174 - protein, 14 aa, Artificial Sequence
  IL6 binding MRD
IWHVFYMVQAGQAG

SEQ ID NO: 1175 - protein, 10 aa, Artificial Sequence
  IL6 binding MRD
RYMHMVWQHI

SEQ ID NO: 1176 - protein, 14 aa, Artificial Sequence
  IL6 binding MRD
PMTMWWFFWKGQAG

SEQ ID NO: 1177 - protein, 10 aa, Artificial Sequence
  IL6 binding MRD
HSFVYMHWFL

SEQ ID NO: 1178 - protein, 14 aa, Artificial Sequence
  IL6 binding MRD
WPMITWLGWYGQAG

SEQ ID NO: 1179 - protein, 14 aa, Artificial Sequence
  IL6 binding MRD
YMFHWPLFWLGQAG

SEQ ID NO: 1180 - protein, 10 aa, Artificial Sequence
  IL6 binding MRD
MQGWLWAKWW

SEQ ID NO: 1181 - protein, 14 aa, Artificial Sequence
  IL6 binding MRD
IYAWWKWHWFGQAG

SEQ ID NO: 1182 - protein, 14 aa, Artificial Sequence
  IL6 binding MRD
TMQPHHIYGYGQAG

SEQ ID NO: 1183 - protein, 14 aa, Artificial Sequence
  IL6 binding MRD
SLFMPQHNVHGQAG

SEQ ID NO: 1184 - protein, 10 aa, Artificial Sequence
  IL6 binding MRD
YWPSLEWDWS

SEQ ID NO: 1185 - protein, 14 aa, Artificial Sequence
  IL6 binding MRD
GCWWVATECWGQAG

SEQ ID NO: 1186 - protein, 14 aa, Artificial Sequence
  IL6 binding MRD
GCTWLIDICTGQAG

SEQ ID NO: 1187 - protein, 10 aa, Artificial Sequence
  IL6 binding MRD
HQLQPYIQDL

SEQ ID NO: 1188 - protein, 14 aa, Artificial Sequence
  IL6 binding MRD
WCLAGHVYCQGQAG

SEQ ID NO: 1189 - protein, 16 aa, Artificial Sequence
  IL6 binding MRD
GVLKSGFRSLRCMARP

SEQ ID NO: 1190 - protein, 16 aa, Artificial Sequence
  IL6 binding MRD
PCPGFPPPMLCMGQAG

SEQ ID NO: 1191 - protein, 14 aa, Artificial Sequence
  IL6 binding MRD
PCMRDWWMCGGQAG

SEQ ID NO: 1192 - protein, 16 aa, Artificial Sequence
  IL6 binding MRD
KCTHLPFQRNCSGQAG

SEQ ID NO: 1193 - protein, 14 aa, Artificial Sequence
  IL6 binding MRD
FCHHWRPVCLGQAG

SEQ ID NO: 1194 - protein, 14 aa, Artificial Sequence
  IL6 binding MRD
ACMLKTHRCKGPGR

SEQ ID NO: 1195 - protein, 12 aa, Artificial Sequence
  IL6 binding MRD
RCSIWKVYAMCM

SEQ ID NO: 1196 - protein, 14 aa, Artificial Sequence
  IL6 binding MRD
ECLWTSLECEGQAG

SEQ ID NO: 1197 - protein, 14 aa, Artificial Sequence
  IL6 binding MRD
VCIPMATMCIGQAG

SEQ ID NO: 1198 - protein, 18 aa, Artificial Sequence
  IL6 binding MRD
SVSWCFWDPLVMQCKDHT

SEQ ID NO: 1199 - protein, 18 aa, Artificial Sequence
  IL6 binding MRD
VHFNCAWDPLMMRCNYDL

SEQ ID NO: 1200 - protein, 18 aa, Artificial Sequence
  IL6 binding MRD
RMSTCLWDPLLMNCKSLW

SEQ ID NO: 1201 - protein, 18 aa, Artificial Sequence
  IL6 binding MRD
TSEPCFWDPLLMTCDYGS

SEQ ID NO: 1202 - protein, 18 aa, Artificial Sequence
  IL6 binding MRD
QNVNCLWDPLRMNCVEYK

SEQ ID NO: 1203 - protein, 18 aa, Artificial Sequence
  IL6 binding MRD
SYIGYTYCPWDPLTMRCV

SEQ ID NO: 1204 - protein, 18 aa, Artificial Sequence
  IL6 binding MRD
LRHFVQYCPWDPLLMACI

SEQ ID NO: 1205 - protein, 18 aa, Artificial Sequence
  IL6 binding MRD
FTIGGPICGWDPLLMRCV

SEQ ID NO: 1206 - protein, 18 aa, Artificial Sequence
  IL6 binding MRD
LLCSENWCRWDPLMMSCR

SEQ ID NO: 1207 - protein, 18 aa, Artificial Sequence
  IL6 binding MRD
FSQMCGWDPLLMMCRSVN

SEQ ID NO: 1208 - protein, 18 aa, Artificial Sequence
  IL6 binding MRD
VGSDCMWDPLMMNCRYSY

SEQ ID NO: 1209 - protein, 18 aa, Artificial Sequence
  IL6 binding MRD
LSLLCHWDPLIMRCSYDS

SEQ ID NO: 1210 - protein, 18 aa, Artificial Sequence
  IL6 binding MRD
YIPPCHWDPLLMDCAQIQ

SEQ ID NO: 1211 - protein, 18 aa, Artificial Sequence
  IL6 binding MRD
MMMECHWDPLLMRCQNPK

SEQ ID NO: 1212 - protein, 18 aa, Artificial Sequence
  IL6 binding MRD
LPSSCYWDPLLMECSHRN

SEQ ID NO: 1213 - protein, 18 aa, Artificial Sequence
  IL6 binding MRD
LVPPLFACFWDPLLMNCS

SEQ ID NO: 1214 - protein, 18 aa, Artificial Sequence
  IL6 binding MRD
WSYFNRSCAWDPLLMKCA

SEQ ID NO: 1215 - protein, 18 aa, Artificial Sequence
  IL6 binding MRD
SSFTVVSCMWDPLLMSCM

SEQ ID NO: 1216 - protein, 18 aa, Artificial Sequence
  IL6 binding MRD
LLTKYRTCHWDPLLMLCR

SEQ ID NO: 1217 - protein, 18 aa, Artificial Sequence
  IL6 binding MRD
MVFWDEFCSWDPLLMACR

SEQ ID NO: 1218 - protein, 18 aa, Artificial Sequence
  IL6 binding MRD
NQLSSIMCHWDPLLMTCQ

SEQ ID NO: 1219 - protein, 18 aa, Artificial Sequence
  IL6 binding MRD
TFTSCSWDPLLMDCTDFV

SEQ ID NO: 1220 - protein, 18 aa, Artificial Sequence
  IL6 binding MRD
MVFYCYWDPLLMLCHDQT

SEQ ID NO: 1221 - protein, 18 aa, Artificial Sequence
  IL6 binding MRD
QVSLCFWDPLMMTCSVPF

SEQ ID NO: 1222 - protein, 18 aa, Artificial Sequence
  IL6 binding MRD
ISMPCSWDPLLMNCAKWP

SEQ ID NO: 1223 - protein, 18 aa, Artificial Sequence
  IL6 binding MRD
FEAWCVWDPLLMNCVTYT

SEQ ID NO: 1224 - protein, 18 aa, Artificial Sequence
  IL6 binding MRD
NRYERFMCFWDPLLMMCS

SEQ ID NO: 1225 - protein, 18 aa, Artificial Sequence
  IL6 binding MRD
VIMNQFFCFWDPLLMRCM

SEQ ID NO: 1226 - protein, 18 aa, Artificial Sequence
  IL6 binding MRD
FSSAYSGCYWDPLLMECI

SEQ ID NO: 1227 - protein, 18 aa, Artificial Sequence
  IL6 binding MRD
WSSGLYGCYWDPLLMLCK

SEQ ID NO: 1228 - protein, 18 aa, Artificial Sequence
  IL6 binding MRD
RSSADWSCLWDPLLMQCM

SEQ ID NO: 1229 - protein, 18 aa, Artificial Sequence
  IL6 binding MRD
ITSLERSCMWDPLLMLCS

SEQ ID NO: 1230 - protein, 18 aa, Artificial Sequence
  IL6 binding MRD
MHGYCTWDPLLMRCSNYI

SEQ ID NO: 1231 - protein, 18 aa, Artificial Sequence
  IL6 binding MRD
STVGCFWDPLLMDCRSMV

SEQ ID NO: 1232 - protein, 18 aa, Artificial Sequence
  IL6 binding MRD
WLSTCLWDPLLMQCIESE

SEQ ID NO: 1233 - protein, 18 aa, Artificial Sequence
  IL6 binding MRD
SGVSCFWDPLRMICYILP

SEQ ID NO: 1234 - protein, 18 aa, Artificial Sequence
  IL6 binding MRD
YLSSCLWDPLLMRCTKLM

SEQ ID NO: 1235 - protein, 18 aa, Artificial Sequence
  IL6 binding MRD
APQQCNWDPLLMNCVKYV

SEQ ID NO: 1236 - protein, 18 aa, Artificial Sequence
  IL6 binding MRD
SYVTFLSCHWDPLRMQCI

SEQ ID NO: 1237 - protein, 18 aa, Artificial Sequence
  IL6 binding MRD
FSSVTSACAWDPLIMRCI

SEQ ID NO: 1238 - protein, 17 aa, Artificial Sequence
  IL6 binding MRD
ALALVASVTGTRYQCRV

SEQ ID NO: 1239 - protein, 18 aa, Artificial Sequence
  IL6 binding MRD
TKNVTYECMWDPLLMVCT

SEQ ID NO: 1240 - protein, 18 aa, Artificial Sequence
  IL6 binding MRD
PFYEYTCCPWDPLLMNCL

SEQ ID NO: 1241 - protein, 18 aa, Artificial Sequence
  IL6 binding MRD
KDYFHQYCIWDPLTMNCA

SEQ ID NO: 1242 - protein, 18 aa, Artificial Sequence
  IL6 binding MRD
HYTNCVWDPLLMRCYEFA

SEQ ID NO: 1243 - protein, 18 aa, Artificial Sequence
  IL6 binding MRD
AVGWCPWDPLLMNCMGRN

SEQ ID NO: 1244 - protein, 18 aa, Artificial Sequence
  IL6 binding MRD
VASVCLWDPLLMQCWSHY

SEQ ID NO: 1245 - protein, 18 aa, Artificial Sequence
  IL6 binding MRD
DGMICLWDPIRMDCYYTE

SEQ ID NO: 1246 - protein, 18 aa, Artificial Sequence
  IL6 binding MRD
DFTFCAWDPLLMACNDQF

SEQ ID NO: 1247 - protein, 18 aa, Artificial Sequence
  IL6 binding MRD
DWEECVWDPLLMMCGISY

SEQ ID NO: 1248 - protein, 18 aa, Artificial Sequence
  IL6 binding MRD
QRNYSEFCHWDPLLMLCQ

SEQ ID NO: 1249 - protein, 18 aa, Artificial Sequence
  IL6 binding MRD
ALVNRVECSWDPLLMKCS

SEQ ID NO: 1250 - protein, 18 aa, Artificial Sequence
  IL6 binding MRD
NLDVTPYCYWDPLRMVCY

SEQ ID NO: 1251 - protein, 18 aa, Artificial Sequence
  IL6 binding MRD
PRFLIYFCNWDPLLMMCK

SEQ ID NO: 1252 - protein, 18 aa, Artificial Sequence
  IL6 binding MRD
YYPITLDCHWDPLLMRCL

SEQ ID NO: 1253 - protein, 18 aa, Artificial Sequence
  IL6 binding MRD
YIEINHPCHWDPLLMDCT

SEQ ID NO: 1254 - protein, 18 aa, Artificial Sequence
  IL6 binding MRD
LVDVCSWDPLLMNCRLAN

SEQ ID NO: 1255 - protein, 18 aa, Artificial Sequence
  IL6 binding MRD
FDTFCFWDPLLMDCAAPT

SEQ ID NO: 1256 - protein, 18 aa, Artificial Sequence
  IL6 binding MRD
QSNDCAWDPLLMQCLNSL

SEQ ID NO: 1257 - protein, 18 aa, Artificial Sequence
  IL6 binding MRD
MTSHCLWDPLLMVCVNHE

SEQ ID NO: 1258 - protein, 18 aa, Artificial Sequence
  IL6 binding MRD
HFTFCAWDPLLMQCGIDS

SEQ ID NO: 1259 - protein, 18 aa, Artificial Sequence
  IL6 binding MRD
KSTALITCIWDPLLMQCR

SEQ ID NO: 1260 - protein, 18 aa, Artificial Sequence
  IL6 binding MRD
YTNNMETCAWDPLLMMCY

SEQ ID NO: 1261 - protein, 18 aa, Artificial Sequence
  IL6 binding MRD
FSGKQMMCAWDPLMMQCA

SEQ ID NO: 1262 - protein, 18 aa, Artificial Sequence
  IL6 binding MRD
LHLGEWDCYWDPLLMICR

SEQ ID NO: 1263 - protein, 18 aa, Artificial Sequence
  IL6 binding MRD
WLFNGVDCLWDPLLMDCI

SEQ ID NO: 1264 - protein, 18 aa, Artificial Sequence
  IL6 binding MRD
FHESLLPCFWDPLLMTCQ

SEQ ID NO: 1265 - protein, 18 aa, Artificial Sequence
  IL6 binding MRD
LYMICTWDPLLMDCREDR

SEQ ID NO: 1266 - protein, 18 aa, Artificial Sequence
  IL6 binding MRD
LNLLCAWDPLLMSCIETL

SEQ ID NO: 1267 - protein, 18 aa, Artificial Sequence
  IL6 binding MRD
WEHGCMWDPLLMQCINRS

SEQ ID NO: 1268 - protein, 18 aa, Artificial Sequence
  IL6 binding MRD
GSTCCVWDPLLMKCMSPV

SEQ ID NO: 1269 - protein, 18 aa, Artificial Sequence
  IL6 binding MRD
GLYNCTWDPLLMRCSESI

SEQ ID NO: 1270 - protein, 18 aa, Artificial Sequence
  IL6 binding MRD
DNWSISSCYWDPLLMNCP

SEQ ID NO: 1271 - protein, 18 aa, Artificial Sequence
  IL6 binding MRD
WFLFPWTCPWDPLLMECI

SEQ ID NO: 1272 - protein, 18 aa, Artificial Sequence
  IL6 binding MRD
SVQYETPCYWDPLRMQCQ

SEQ ID NO: 1273 - protein, 18 aa, Artificial Sequence
  IL6 binding MRD
LDFSFFDCSWDPLLMRCS

SEQ ID NO: 1274 - protein, 18 aa, Artificial Sequence
  IL6 binding MRD
FRMKKVDCCWDPLLMNCR

SEQ ID NO: 1275 - protein, 18 aa, Artificial Sequence
  IL6 binding MRD
NAPVWVECMWDPLLMSCV

SEQ ID NO: 1276 - protein, 18 aa, Artificial Sequence
  IL6 binding MRD
GYAWCFWDPLLMKCTWQV

SEQ ID NO: 1277 - protein, 18 aa, Artificial Sequence
  IL6 binding MRD
DDFLCSWDPLLMDCMVYP

SEQ ID NO: 1278 - protein, 18 aa, Artificial Sequence
  IL6 binding MRD
FEDSCAWDPLLMACSNPI

SEQ ID NO: 1279 - protein, 17 aa, Artificial Sequence
  IL6 binding MRD
LAGSVSGTLLQQTVQRT

SEQ ID NO: 1280 - protein, 18 aa, Artificial Sequence
  IL6 binding MRD
LVSFCAWDPLLMNCMWPM

SEQ ID NO: 1281 - protein, 18 aa, Artificial Sequence
  IL6 binding MRD
LYGECAWDPLLMRCQPYY

SEQ ID NO: 1282 - protein, 18 aa, Artificial Sequence
  IL6 binding MRD
GSKRFGICFWDPLLMDCA

SEQ ID NO: 1283 - protein, 18 aa, Artificial Sequence
  IL6 binding MRD
YVAVGPSCLWDPLLMMCA

SEQ ID NO: 1284 - protein, 18 aa, Artificial Sequence
  IL6 binding MRD
GFGSSWFCSWDPLLMQCQ

SEQ ID NO: 1285 - protein, 18 aa, Artificial Sequence
  IL6 binding MRD
SISRAFSCVWDPLLMNCS

SEQ ID NO: 1286 - protein, 18 aa, Artificial Sequence
  IL6 binding MRD
MTQSLSFCHWDPLLMYCV

SEQ ID NO: 1287 - protein, 18 aa, Artificial Sequence
  IL6 binding MRD
LVPYSWYCVWDPLLMDCV

SEQ ID NO: 1288 - protein, 18 aa, Artificial Sequence
  IL6 binding MRD
SDNLYFDCHWDPLLMMCR

SEQ ID NO: 1289 - protein, 18 aa, Artificial Sequence
  IL6 binding MRD
LFTMCHWDPLLMDCATVP

SEQ ID NO: 1290 - protein, 18 aa, Artificial Sequence
  IL6 binding MRD
FCSWDPMLMDCSTITFDM

SEQ ID NO: 1291 - protein, 18 aa, Artificial Sequence
  IL6 binding MRD
TQMYCWWDPLLMNCTEMS

SEQ ID NO: 1292 - protein, 18 aa, Artificial Sequence
  IL6 binding MRD
LTGYCYWDPLLMNCLEQG

SEQ ID NO: 1293 - protein, 18 aa, Artificial Sequence
  IL6 binding MRD
NHPMCWWDPLMMDCMYFE

SEQ ID NO: 1294 - protein, 18 aa, Artificial Sequence
  IL6 binding MRD
PDTLCIWDPLLMQCRWMP

SEQ ID NO: 1295 - protein, 18 aa, Artificial Sequence
  IL6 binding MRD
VNVSFWGCVWDPLLMVCS

SEQ ID NO: 1296 - protein, 18 aa, Artificial Sequence
  IL6 binding MRD
KAVLSNYCYWDPLLMICS

SEQ ID NO: 1297 - protein, 18 aa, Artificial Sequence
  IL6 binding MRD
LGRLVPYCRWDPLSMVCL

SEQ ID NO: 1298 - protein, 18 aa, Artificial Sequence
  IL6 binding MRD
RWKIDVICKVEILQRRCT

SEQ ID NO: 1299 - protein, 18 aa, Artificial Sequence
  IL6 binding MRD
SHIACGWDPLMMMCTQEM

SEQ ID NO: 1300 - protein, 18 aa, Artificial Sequence
  IL6 binding MRD
ICWWDPLLMDCISTVEPY

SEQ ID NO: 1301 - protein, 18 aa, Artificial Sequence
  IL6 binding MRD
MFLSVVDCFWDPLLMECV

SEQ ID NO: 1302 - protein, 18 aa, Artificial Sequence
  IL6 binding MRD
HCYWDPLLMTCYDSGPWV

SEQ ID NO: 1303 - protein, 18 aa, Artificial Sequence
  IL6 binding MRD
IFEYCVWDPLLLRCSLNS

SEQ ID NO: 1304 - protein, 18 aa, Artificial Sequence
  IL6 binding MRD
FVDDCVWDPLMMDCHRYS

SEQ ID NO: 1305 - protein, 18 aa, Artificial Sequence
  IL6 binding MRD
KLALLDDCIWDPLLMSCR

SEQ ID NO: 1306 - protein, 18 aa, Artificial Sequence
  IL6 binding MRD
WTNWCGWVLPTMLCMYWI

SEQ ID NO: 1307 - protein, 18 aa, Artificial Sequence
  IL6 binding MRD
DWSTLYFCSWDPLLMLCS

SEQ ID NO: 1308 - protein, 18 aa, Artificial Sequence
  IL6 binding MRD
GQNHCFWDPLMMICLNGH

SEQ ID NO: 1309 - protein, 18 aa, Artificial Sequence
  IL6 binding MRD
TLLTCVWDPLLMQCRDLE

SEQ ID NO: 1310 - protein, 18 aa, Artificial Sequence
  IL6 binding MRD
YVSPCVWDPLLMLCNESW

SEQ ID NO: 1311 - protein, 18 aa, Artificial Sequence
  IL6 binding MRD
LCFWDPLYMECSTHLYID

SEQ ID NO: 1312 - protein, 18 aa, Artificial Sequence
  IL6 binding MRD
LLAWCFWDPLLMDCVWDS

SEQ ID NO: 1313 - protein, 18 aa, Artificial Sequence
  IL6 binding MRD
YHYLSVNCHWDPLLMECT

SEQ ID NO: 1314 - protein, 18 aa, Artificial Sequence
  IL6 binding MRD
FHHFCFWDPLLMGCMNYN

SEQ ID NO: 1315 - protein, 18 aa, Artificial Sequence
  IL6 binding MRD
FCVWDPLLMLCQWLEDSS

SEQ ID NO: 1316 - protein, 18 aa, Artificial Sequence
  IL6 binding MRD
FNTQSTDCWWDPLLMLCA

SEQ ID NO: 1317 - protein, 18 aa, Artificial Sequence
  IL6 binding MRD
VQLTCFWDPLMMWCSEQS

SEQ ID NO: 1318 - protein, 18 aa, Artificial Sequence
  IL6 binding MRD
LRAICIWDPLMMLCGTMG

SEQ ID NO: 1319 - protein, 18 aa, Artificial Sequence
  IL6 binding MRD
ISFPHFICPWDPLLMQCS

SEQ ID NO: 1320 - protein, 18 aa, Artificial Sequence
  IL6 binding MRD
RSFVCNWDPLMMTCTSDL

SEQ ID NO: 1321 - protein, 18 aa, Artificial Sequence
  IL6 binding MRD
PLWSCFWDPLLMDCQWTL

SEQ ID NO: 1322 - protein, 18 aa, Artificial Sequence
  IL6 binding MRD
SHSSNMGCYWDPLMMMCH

SEQ ID NO: 1323 - protein, 18 aa, Artificial Sequence
  IL6 binding MRD
RVYECYWDPLIMDCTWDL

SEQ ID NO: 1324 - protein, 18 aa, Artificial Sequence
  IL6 binding MRD
FSVNYTPCVWDPLLMRCS

SEQ ID NO: 1325 - protein, 18 aa, Artificial Sequence
  IL6 binding MRD
LVALPNSCFWDPLLMTCR

SEQ ID NO: 1326 - protein, 18 aa, Artificial Sequence
  IL6 binding MRD
FWVGCPWDPLLMKCTSYN

SEQ ID NO: 1327 - protein, 18 aa, Artificial Sequence
  IL6 binding MRD
KLALMSSCLWDPLLMDCM

SEQ ID NO: 1328 - protein, 18 aa, Artificial Sequence
  IL6 binding MRD
HCYWDPLLMDCKYLILEG

SEQ ID NO: 1329 - protein, 18 aa, Artificial Sequence
  IL6 binding MRD
GSIICWWDPLLMSCADLK

SEQ ID NO: 1330 - protein, 18 aa, Artificial Sequence
  IL6 binding MRD
QLFTCHWDPLLMDCTWDS

SEQ ID NO: 1331 - protein, 18 aa, Artificial Sequence
  IL6 binding MRD
WLEQCVWDPLLMSCTSYV

SEQ ID NO: 1332 - protein, 18 aa, Artificial Sequence
  IL6 binding MRD
SSPGIDACWWDPLLMDCA

SEQ ID NO: 1333 - protein, 18 aa, Artificial Sequence
  IL6 binding MRD
LHFVCFWDPLIMDCSPQM

SEQ ID NO: 1334 - protein, 18 aa, Artificial Sequence
  IL6 binding MRD
SYAYCYWDPLLMECADPM

SEQ ID NO: 1335 - protein, 18 aa, Artificial Sequence
  IL6 binding MRD
VWLVFWPCFLDPISSICN

SEQ ID NO: 1336 - protein, 18 aa, Artificial Sequence
  IL6 binding MRD
SLLECFWDPLMMNCSNGL

SEQ ID NO: 1337 - protein, 18 aa, Artificial Sequence
  IL6 binding MRD
SDDWTMECYWDPLLMTCI

SEQ ID NO: 1338 - protein, 18 aa, Artificial Sequence
  IL6 binding MRD
ALMFCFWDPLLMRCNANV

SEQ ID NO: 1339 - protein, 18 aa, Artificial Sequence
  IL6 binding MRD
NRLMCFWDPLLMVCQSDL

SEQ ID NO: 1340 - protein, 18 aa, Artificial Sequence
  IL6 binding MRD
LMQRPVHCVWDPLLMNCR

SEQ ID NO: 1341 - protein, 18 aa, Artificial Sequence
  IL6 binding MRD
WQCYYRLCMGYPLGILCS

SEQ ID NO: 1342 - protein, 18 aa, Artificial Sequence
  IL6 binding MRD
FRFATFFCYWDPLLMSCR

SEQ ID NO: 1343 - protein, 18 aa, Artificial Sequence
  IL6 binding MRD
LTFLFYRCSWESVTPGCI

SEQ ID NO: 1344 - protein, 18 aa, Artificial Sequence
  IL6 binding MRD
LLLSTYWCSWDPLLMDCN

SEQ ID NO: 1345 - protein, 18 aa, Artificial Sequence
  IL6 binding MRD
SLWLTVLCPWDPLLMACI

SEQ ID NO: 1346 - protein, 18 aa, Artificial Sequence
  IL6 binding MRD
TSGLCVWDPLMMSCASLL

SEQ ID NO: 1347 - protein, 18 aa, Artificial Sequence
  IL6 binding MRD
LIMGCPWDPLLMLCQERR

SEQ ID NO: 1348 - protein, 18 aa, Artificial Sequence
  IL6 binding MRD
SNPICIWDPLLMRCIWYQ

SEQ ID NO: 1349 - protein, 18 aa, Artificial Sequence
  IL6 binding MRD
QSFLMRGCAWDPLLMQCI

SEQ ID NO: 1350 - protein, 18 aa, Artificial Sequence
  IL6 binding MRD
LVVNCPWDPLLMACAVNV

SEQ ID NO: 1351 - protein, 18 aa, Artificial Sequence
  IL6 binding MRD
STRDCYWDPLLMTCINYI

SEQ ID NO: 1352 - protein, 18 aa, Artificial Sequence
  IL6 binding MRD
SYQVCCWDPLLMTCQRAR

SEQ ID NO: 1353 - protein, 18 aa, Artificial Sequence
  IL6 binding MRD
YHWQLNGCVWHPLMINCL

SEQ ID NO: 1354 - protein, 18 aa, Artificial Sequence
  IL6 binding MRD
LCLWDALLMECRIHSFDS

SEQ ID NO: 1355 - protein, 18 aa, Artificial Sequence
  IL6 binding MRD
FCVWDPLLMHCRFTHDRM

SEQ ID NO: 1356 - protein, 18 aa, Artificial Sequence
  IL6 binding MRD
SMTMCGWNPLGMWCHSLG

SEQ ID NO: 1357 - protein, 18 aa, Artificial Sequence
  IL6 binding MRD
TLVSLGLCAWDPLLMSCA

SEQ ID NO: 1358 - protein, 18 aa, Artificial Sequence
  IL6 binding MRD
SFLFYSSCVWDPLLMQCG

SEQ ID NO: 1359 - protein, 18 aa, Artificial Sequence
  IL6 binding MRD
TLDNCAWDPLLMRCWGQW

SEQ ID NO: 1360 - protein, 18 aa, Artificial Sequence
  IL6 binding MRD
SSIYCLWDPLLMRCATPL

SEQ ID NO: 1361 - protein, 18 aa, Artificial Sequence
  IL6 binding MRD
RCPWDPLMMMCIEEMYTD

SEQ ID NO: 1362 - protein, 18 aa, Artificial Sequence
  IL6 binding MRD
LCSWDPLMMRCVVMDSLD

SEQ ID NO: 1363 - protein, 18 aa, Artificial Sequence
  IL6 binding MRD
FFCLWHFCTGDPLKIHCM

SEQ ID NO: 1364 - protein, 18 aa, Artificial Sequence
  IL6 binding MRD
QLFLTLNCSWDPLLMQCL

SEQ ID NO: 1365 - protein, 18 aa, Artificial Sequence
  IL6 binding MRD
SYLGGLACAWDPLLMQCI

SEQ ID NO: 1366 - protein, 18 aa, Artificial Sequence
  IL6 binding MRD
GFPECFWDPLLMDCTYWF

SEQ ID NO: 1367 - protein, 18 aa, Artificial Sequence
  IL6 binding MRD
VFPWCYWDPLMMDCAIQN

SEQ ID NO: 1368 - protein, 18 aa, Artificial Sequence
  IL6 binding MRD
FCVWDPLLMDCSGNTFYF

SEQ ID NO: 1369 - protein, 18 aa, Artificial Sequence
  IL6 binding MRD
TCAWDPLLMVCRYPCPAF

SEQ ID NO: 1370 - protein, 18 aa, Artificial Sequence
  IL6 binding MRD
AALECPWDPLMMSCIKTS

SEQ ID NO: 1371 - protein, 18 aa, Artificial Sequence
  IL6 binding MRD
YLPSWLSCSWDPLLMICS

SEQ ID NO: 1372 - protein, 18 aa, Artificial Sequence
  IL6 binding MRD
HLSLLMDCCWDPLTMQCT

SEQ ID NO: 1373 - protein, 18 aa, Artificial Sequence
  IL6 binding MRD
RWPFCHWDPLLMMCSVSY

SEQ ID NO: 1374 - protein, 18 aa, Artificial Sequence
  IL6 binding MRD
LPLLRFPCDGKQLWKFCL

SEQ ID NO: 1375 - protein, 18 aa, Artificial Sequence
  IL6 binding MRD
QVSYCPWDPLLMQCQLSG

SEQ ID NO: 1376 - protein, 18 aa, Artificial Sequence
  IL6 binding MRD
RSIECFWDPLMMECMGYV

SEQ ID NO: 1377 - protein, 18 aa, Artificial Sequence
  IL6 binding MRD
LGMTFYVCPWDPLLMLCI

SEQ ID NO: 1378 - protein, 18 aa, Artificial Sequence
  IL6 binding MRD
YYYSWPMCYWDPHMLFCL

SEQ ID NO: 1379 - protein, 18 aa, Artificial Sequence
  IL6 binding MRD
PCYWDPLLMRCMLQVDNW

SEQ ID NO: 1380 - protein, 18 aa, Artificial Sequence
  IL6 binding MRD
FFSDCNWDPLLMHCANKL

SEQ ID NO: 1381 - protein, 18 aa, Artificial Sequence
  IL6 binding MRD
RPSLVPICYWDPLLMICI

SEQ ID NO: 1382 - protein, 18 aa, Artificial Sequence
  IL6 binding MRD
NYFNCVWDPLRMDCQYFM

SEQ ID NO: 1383 - protein, 41 aa, Artificial Sequence
  IL6 binding MRD
DWQYYSSKTYGQAGQGSATGGSSFNEDCMWDPLLMDCAYSP

SEQ ID NO: 1384 - protein, 35 aa, Artificial Sequence
  IL6 binding MRD
PDWITWQPAWGQAGQGSFNEDCMWDPLLMDCAYSP

SEQ ID NO: 1385 - protein, 40 aa, Artificial Sequence
  IL6 binding MRD
NMYHEHAAWGQAGQGSATGGSSFNEDCMWDPLLMDCAYSP

SEQ ID NO: 1386 - protein, 35 aa, Artificial Sequence
  IL6 binding MRD
EVNHVEDFPAGQAGQGSFNEDCMWDPLLMDCAYSP

SEQ ID NO: 1387 - protein, 40 aa, Artificial Sequence
  IL6 binding MRD
WYTHSLQMWGQAGQGSATGGSSFNEDCMWDPLLMDCAYSP

SEQ ID NO: 1388 - protein, 35 aa, Artificial Sequence
  IL6 binding MRD
GPDVTQYVKFGQAGQGSFNEDCMWDPLLMDCAYSP

SEQ ID NO: 1389 - protein, 35 aa, Artificial Sequence
  IL6 binding MRD
QSPSASHIMGGQAGQGSFNEDCMWDPLLMDCAYSP

SEQ ID NO: 1390 - protein, 41 aa, Artificial Sequence
  IL6 binding MRD
GPVEESAPQYGQAGQGSATGGSSFNEDCMWDPLLMDCAYSP

SEQ ID NO: 1391 - protein, 46 aa, Artificial Sequence
  IL6 binding MRD
WIMSLSWPMAGQAGQGSATGGSGSTASSFNEDCMWDPLLMDCAYSP

SEQ ID NO: 1392 - protein, 35 aa, Artificial Sequence
  IL6 binding MRD
HVGWHAMNPWGQAGQGSFNEDCMWDPLLMDCAYSP

SEQ ID NO: 1393 - protein, 41 aa, Artificial Sequence
  IL6 binding MRD
VWTAFIQMNSGQAGQGSATGGSSFNEDCMWDPLLMDCAYSP

SEQ ID NO: 1394 - protein, 41 aa, Artificial Sequence
  IL6 binding MRD
PDWITWQPAWGQAGQGSATGGSSFNEDCMWDPLLMDCAYSP

SEQ ID NO: 1395 - protein, 35 aa, Artificial Sequence
  IL6 binding MRD
VMWQWEEGHWGQAGQGSFNEDCMWDPLLMDCAYSP

SEQ ID NO: 1396 - protein, 41 aa, Artificial Sequence
  IL6 binding MRD
TQEMWFTGINGQAGQGSATGGSSFNEDCMWDPLLMDCAYSP

SEQ ID NO: 1397 - protein, 35 aa, Artificial Sequence
  IL6 binding MRD
DNWWRIWDKQGQAGQGSFNEDCMWDPLLMDCAYSP

SEQ ID NO: 1398 - protein, 35 aa, Artificial Sequence
  IL6 binding MRD
VTWFMYQDRAGQAGQGSFNEDCMWDPLLMDCAYSP

SEQ ID NO: 1399 - protein, 18 aa, Artificial Sequence
  IL6 binding MRD
LPPPCYWTTWGKECQMFD

SEQ ID NO: 1400 - protein, 35 aa, Artificial Sequence
  IL6 binding MRD
VEPIPYTMMRGQAGQGSFNEDCMWDPLLMDCAYSP

SEQ ID NO: 1401 - protein, 41 aa, Artificial Sequence
  IL6 binding MRD
RIVVMEQMQIGQAGQGSATGGSSFNEDCMWDPLLMDCAYSP

SEQ ID NO: 1402 - protein, 41 aa, Artificial Sequence
  IL6 binding MRD
MCNPMESECHGQAGQGSATGGSSFNEDCMWDPLLMDCAYSP

SEQ ID NO: 1403 - protein, 35 aa, Artificial Sequence
  IL6 binding MRD
VYWYDVKWTWGQAGQGSFNEDCMWDPLLMDCAYSP

SEQ ID NO: 1404 - protein, 35 aa, Artificial Sequence
  IL6 binding MRD
DCEQNQTYCVGQAGQGSFNEDCMWDPLLMDCAYSP

SEQ ID NO: 1405 - protein, 37 aa, Artificial Sequence
  IL6 binding MRD
WWPNYTWDHPQGSATGGSSFNEDCMWDPLLMDCAYSP

SEQ ID NO: 1406 - protein, 54 aa, Artificial Sequence
  IL6 binding MRD
DGSPGYRAYHSQFGQAGQGSATGGSGSTASSGSGSSFNEDCMWDPLLMDCAYSP

SEQ ID NO: 1407 - protein, 35 aa, Artificial Sequence
  IL6 binding MRD
WPWFEQEHFWGQAGQGSFNEDCMWDPLLMDCAYSP

SEQ ID NO: 1408 - protein, 36 aa, Artificial Sequence
  IL6 binding MRD
WCRPTDLKLVKGQAGQGSFNEDCMWDPLLMDCAYSP

SEQ ID NO: 1409 - protein, 35 aa, Artificial Sequence
  IL6 binding MRD
DKSGGLVAIQGQAGQGSFNEDCMWDPLLMDCAYSP

SEQ ID NO: 1410 - protein, 35 aa, Artificial Sequence
  IL6 binding MRD
DRWGWQKEPSGQAGQGSFNEDCMWDPLLMDCAYSP

SEQ ID NO: 1411 - protein, 51 aa, Artificial Sequence
  IL6 binding MRD
LAWKQSWIDTGQAGQGSATGGSGSTASSGSGSSFNEDCMWDPLLMDCAYSP

SEQ ID NO: 1412 - protein, 41 aa, Artificial Sequence
  IL6 binding MRD
VMLEQMPMMRGQAGQGSATGGSSFNEDCMWDPLLMDCAYSP

SEQ ID NO: 1413 - protein, 41 aa, Artificial Sequence
  IL6 binding MRD
ATRMWPMSISGQAGQGSATGGSSFNEDCMWDPLLMDCAYSP

SEQ ID NO: 1414 - protein, 35 aa, Artificial Sequence
  IL6 binding MRD
MYVMKWQNWTGQAGQGSFNEDCMWDPLLMDCAYSP

SEQ ID NO: 1415 - protein, 35 aa, Artificial Sequence
  IL6 binding MRD
ISDVYQWHSYGQAGQGSFNEDCMWDPLLMDCAYSP

SEQ ID NO: 1416 - protein, 35 aa, Artificial Sequence
  IL6 binding MRD
MVKLWEIYSWGQAGQGSFNEDCMWDPLLMDCAYSP

SEQ ID NO: 1417 - protein, 35 aa, Artificial Sequence
  IL6 binding MRD
QWGWSMWQEVGQAGQGSFNEDCMWDPLLMDCAYSP

SEQ ID NO: 1418 - protein, 62 aa, Artificial Sequence
  IL6 binding MRD
MWSAVFQPYQGQAGQGSATGGSSFNEDCMWDPLLMDCAYSPGGSFNEDCMWDPLLMDCAYSP

SEQ ID NO: 1419 - protein, 35 aa, Artificial Sequence
  IL6 binding MRD
AMHNVMWRAMGQAGQGSFNEDCMWDPLLMDCAYSP

SEQ ID NO: 1420 - protein, 41 aa, Artificial Sequence
  IL6 binding MRD
HEDKFIVWMWGQAGQGSATGGSSFNEDCMWDPLLMDCAYSP

SEQ ID NO: 1421 - protein, 41 aa, Artificial Sequence
  IL6 binding MRD
QWWWTNSPWLGQAGQGSATGGSSFNEDCMWDPLLMDCAYSP

SEQ ID NO: 1422 - protein, 35 aa, Artificial Sequence
  IL6 binding MRD
QHQTAFTEMVGQAGQGSFNEDCMWDPLLMDCAYSP

SEQ ID NO: 1423 - protein, 35 aa, Artificial Sequence
  IL6 binding MRD
QTMWTRWMHDGQAGQGSFNEDCMWDPLLMDCAYSP

SEQ ID NO: 1424 - protein, 35 aa, Artificial Sequence
  IL6 binding MRD
YAWHHHVLNTGQAGQGSFNEDCMWDPLLMDCAYSP

SEQ ID NO: 1425 - protein, 51 aa, Artificial Sequence
  IL6 binding MRD
YCPFMPALCVGQAGQGSATGGSGSTASSGSGSSFNEDCMWDPLLMDCAYSP

SEQ ID NO: 1426 - protein, 35 aa, Artificial Sequence
  IL6 binding MRD
RTYSTPYWGWGQAGQGSFNEDCMWDPLLMDCAYSP

SEQ ID NO: 1427 - protein, 41 aa, Artificial Sequence
  IL6 binding MRD
EIFWWLLQWEGQAGQGSATGGSSFNEDCMWDPLLMDCAYSP

SEQ ID NO: 1428 - protein, 41 aa, Artificial Sequence
  IL6 binding MRD
QIDFKYMMWTGQAGQGSATGGSSFNEDCMWDPLLMDCAYSP

SEQ ID NO: 1429 - protein, 41 aa, Artificial Sequence
  IL6 binding MRD
QMQWLDDEFYGQAGQGSATGGSSFNEDCMWDPLLMDCAYSP

SEQ ID NO: 1430 - protein, 35 aa, Artificial Sequence
  IL6 binding MRD
PVQQEWMQWYGQAGQGSFNEDCMWDPLLMDCAYSP

SEQ ID NO: 1431 - protein, 41 aa, Artificial Sequence
  IL6 binding MRD
QAWKLMWFAWGQAGQGSATGGSSFNEDCMWDPLLMDCAYSP

SEQ ID NO: 1432 - protein, 35 aa, Artificial Sequence
  IL6 binding MRD
MPSTQINQWVGQAGQGSFNEDCMWDPLLMDCAYSP

SEQ ID NO: 1433 - protein, 41 aa, Artificial Sequence
  IL6 binding MRD
TEKDPAQDWWGQAGQGSATGGSSFNEDCMWDPLLMDCAYSP

SEQ ID NO: 1434 - protein, 41 aa, Artificial Sequence
  IL6 binding MRD
EYTNTSWKGHGQAGQGSATGGSSFNEDCMWDPLLMDCAYSP

SEQ ID NO: 1435 - protein, 41 aa, Artificial Sequence
  IL6 binding MRD
QMEVAHVVDLGQAGQGSATGGSSFNEDCMWDPLLMDCAYSP

SEQ ID NO: 1436 - protein, 41 aa, Artificial Sequence
  IL6 binding MRD
IKPSSHWWWQGQAGQGSATGGSSFNEDCMWDPLLMDCAYSP

SEQ ID NO: 1437 - protein, 46 aa, Artificial Sequence
  IL6 binding MRD
YEEQQVDEFGGQAGQGSATGGSGSTASSFNEDCMWDPLLMDCAYSP

SEQ ID NO: 1438 - protein, 35 aa, Artificial Sequence
  IL6 binding MRD
AWWQGQRPYNGQAGQGSFNEDCMWDPLLMDCAYSP

SEQ ID NO: 1439 - protein, 37 aa, Artificial Sequence
  IL6 binding MRD
PPLWMSQMVPQGSATGGSSFNEDCMWDPLLMDCAYSP

SEQ ID NO: 1440 - protein, 41 aa, Artificial Sequence
  IL6 binding MRD
VEHLSHSYVLGQAGQGSATGGSSFNEDCMWDPLLMDCAYSP

SEQ ID NO: 1441 - protein, 41 aa, Artificial Sequence
  IL6 binding MRD
DCSPDVHDCHGQAGQGSATGGSSFNEDCMWDPLLMDCAYSP

SEQ ID NO: 1442 - protein, 35 aa, Artificial Sequence
  IL6 binding MRD
TYLQLWYFIQGQAGQGSFNEDCMWDPLLMDCAYSP

SEQ ID NO: 1443 - protein, 35 aa, Artificial Sequence
  IL6 binding MRD
GRWWMVQWVEGQAGQGSFNEDCMWDPLLMDCAYSP

SEQ ID NO: 1444 - protein, 35 aa, Artificial Sequence
  IL6 binding MRD
VMEGHQFAQFGQAGQGSFNEDCMWDPLLMDCAYSP

SEQ ID NO: 1445 - protein, 35 aa, Artificial Sequence
  IL6 binding MRD
WWSPSYAWVMGQAGQGSFNEDCMWDPLLMDCAYSP

SEQ ID NO: 1446 - protein, 35 aa, Artificial Sequence
  IL6 binding MRD
MEMVSAAWQEGQAGQGSFNEDCMWDPLLMDCAYSP

SEQ ID NO: 1447 - protein, 41 aa, Artificial Sequence
  IL6 binding MRD
YWWTIDYWPYGQAGQGSATGGSSFNEDCMWDPLLMDCAYSP

SEQ ID NO: 1448 - protein, 35 aa, Artificial Sequence
  IL6 binding MRD
YPMYYYQDISGQAGQGSFNEDCMWDPLLMDCAYSP

SEQ ID NO: 1449 - protein, 35 aa, Artificial Sequence
  IL6 binding MRD
IMWAGPIFPNGQAGQGSFNEDCMWDPLLMDCAYSP

SEQ ID NO: 1450 - protein, 35 aa, Artificial Sequence
  IL6 binding MRD
IMGMYEGFRTGQAGQGSFNEDCMWDPLLMDCAYSP

SEQ ID NO: 1451 - protein, 41 aa, Artificial Sequence
  IL6 binding MRD
IERAYHSTRWGQAGQGSATGGSSFNEDCMWDPLLMDCAYSP

SEQ ID NO: 1452 - protein, 35 aa, Artificial Sequence
  IL6 binding MRD
ETELKKPAMQGQAGQGSFNEDCMWDPLLMDCAYSP

SEQ ID NO: 1453 - protein, 35 aa, Artificial Sequence
  IL6 binding MRD
QDWHYPWVYQGQAGQGSFNEDCMWDPLLMDCAYSP

SEQ ID NO: 1454 - protein, 35 aa, Artificial Sequence
  IL6 binding MRD
PLQKWEHIVNGQAGQGSFNEDCMWDPLLMDCAYSP

SEQ ID NO: 1455 - protein, 19 aa, Artificial Sequence
  IL6 binding MRD
TDSWCHTLYWALQHCVAQE

SEQ ID NO: 1456 - protein, 46 aa, Artificial Sequence
  IL6 binding MRD
WQNPWPVRFWGQAGQGSATGGSGSTASSFNEDCMWDPLLMDCAYSP

SEQ ID NO: 1457 - protein, 35 aa, Artificial Sequence
  IL6 binding MRD
APGVAMWMFIGQAGQGSFNEDCMWDPLLMDCAYSP

SEQ ID NO: 1458 - protein, 46 aa, Artificial Sequence
  IL6 binding MRD
QSNGAHAWVWGQAGQGSATGGSGSTASSFNEDCMWDPLLMDCAYSP

SEQ ID NO: 1459 - protein, 19 aa, Artificial Sequence
  IL6 binding MRD
PDSSCHTLYWQLHHCARRE

SEQ ID NO: 1460 - protein, 35 aa, Artificial Sequence
  IL6 binding MRD
KWNQQWTIARGQAGQGSFNEDCMWDPLLMDCAYSP

SEQ ID NO: 1461 - protein, 36 aa, Artificial Sequence
  IL6 binding MRD
ECSCAKSRYANGQAGQGSFNEDCMWDPLLMDCAYSP

SEQ ID NO: 1462 - protein, 43 aa, Artificial Sequence
  IL6 binding MRD
SCQFLEEYKDCRGQAGQGSATGGSSFNEDCMWDPLLMDCAYSP

SEQ ID NO: 1463 - protein, 41 aa, Artificial Sequence
  IL6 binding MRD
VPSLIYHTYYGQAGQGSATGGSSFNEDCMWDPLLMDCAYSP

SEQ ID NO: 1464 - protein, 46 aa, Artificial Sequence
  IL6 binding MRD
SIYISYRQNHGQAGQGSATGGSGSTASSFNEDCMWDPLLMDCAYSP

SEQ ID NO: 1465 - protein, 35 aa, Artificial Sequence
  IL6 binding MRD
TYYTHTAWDRGQAGQGSFNEDCMWDPLLMDCAYSP

SEQ ID NO: 1466 - protein, 35 aa, Artificial Sequence
  IL6 binding MRD
LLVEFFKHTYGQAGQGSFNEDCMWDPLLMDCAYSP

SEQ ID NO: 1467 - protein, 51 aa, Artificial Sequence
  IL6 binding MRD
FQGHWHIKKQGQAGQGSATGGSGSTASSGSGSSFNEDCMWDPLLMDCAYSP

SEQ ID NO: 1468 - protein, 41 aa, Artificial Sequence
  IL6 binding MRD
FHLPIHWHYQGQAGQGSATGGSSFNEDCMWDPLLMDCAYSP

SEQ ID NO: 1469 - protein, 35 aa, Artificial Sequence
  IL6 binding MRD
LIVLQPKNMVGQAGQGSFNEDCMWDPLLMDCAYSP

SEQ ID NO: 1470 - protein, 35 aa, Artificial Sequence
  IL6 binding MRD
TYSWRDWGMYGQAGQGSFNEDCMWDPLLMDCAYSP

SEQ ID NO: 1471 - protein, 38 aa, Artificial Sequence
  IL6 binding MRD
DGSHPIVVVTEWFGQAGQGSFNEDCMWDPLLMDCAYSP

SEQ ID NO: 1472 - protein, 35 aa, Artificial Sequence
  IL6 binding MRD
VYWQAMNQDYGQAGQGSFNEDCMWDPLLMDCAYSP

SEQ ID NO: 1473 - protein, 19 aa, Artificial Sequence
  IL6 binding MRD
PDSWCHTLYWDLLYCVNQE

SEQ ID NO: 1474 - protein, 42 aa, Artificial Sequence
  IL6 binding MRD
DCAMWFMFKDQGQAGQGSATGGSSFNEDCMWDPLLMDCAYSP

SEQ ID NO: 1475 - protein, 41 aa, Artificial Sequence
  IL6 binding MRD
NNMHPLWPISGQAGQGSATGGSSFNEDCMWDPLLMDCAYSP

SEQ ID NO: 1476 - protein, 35 aa, Artificial Sequence
  IL6 binding MRD
FWYSWNPQWDGQAGQGSFNEDCMWDPLLMDCAYSP

SEQ ID NO: 1477 - protein, 35 aa, Artificial Sequence
  IL6 binding MRD
EGYWRGPHWEGQAGQGSFNEDCMWDPLLMDCAYSP

SEQ ID NO: 1478 - protein, 35 aa, Artificial Sequence
  IL6 binding MRD
YRMKWDFMLHGQAGQGSFNEDCMWDPLLMDCAYSP

SEQ ID NO: 1479 - protein, 46 aa, Artificial Sequence
  IL6 binding MRD
WWWDQHMLENGQAGQGSATGGSGSTASSFNEDCMWDPLLMDCAYSP

SEQ ID NO: 1480 - protein, 35 aa, Artificial Sequence
  IL6 binding MRD
PCHWAQQPCAGQAGQGSFNEDCMWDPLLMDCAYSP

SEQ ID NO: 1481 - protein, 41 aa, Artificial Sequence
  IL6 binding MRD
FFDFFSFSNSGQAGQGSATGGSSFNEDCMWDPLLMDCAYSP

SEQ ID NO: 1482 - protein, 35 aa, Artificial Sequence
  IL6 binding MRD
VWTAFIQMNSGQAGQGSFNEDCMWDPLLMDCAYSP

SEQ ID NO: 1483 - protein, 35 aa, Artificial Sequence
  IL6 binding MRD
QIQQFSFWVQGQAGQGSFNEDCMWDPLLMDCAYSP

SEQ ID NO: 1484 - protein, 35 aa, Artificial Sequence
  IL6 binding MRD
LFIPYMAQIWGQAGQGSFNEDCMWDPLLMDCAYSP

SEQ ID NO: 1485 - protein, 46 aa, Artificial Sequence
  IL6 binding MRD
MTTMYHIIVLGQAGQGSATGGSGSTASSFNEDCMWDPLLMDCAYSP

SEQ ID NO: 1486 - protein, 39 aa, Artificial Sequence
  IL6 binding MRD
GCSMCHMMMVKWHRGQAGQGSFNEDCMWDPLLMDCAYSP

SEQ ID NO: 1487 - protein, 31 aa, Artificial Sequence
  IL6 binding MRD
EQHVDWYWVPQGSFNEDCMWDPLLMDCAYSP

SEQ ID NO: 1488 - protein, 35 aa, Artificial Sequence
  IL6 binding MRD
NQTQPKRPTDGQAGQGSFNEDCMWDPLLMDCAYSP

SEQ ID NO: 1489 - protein, 35 aa, Artificial Sequence
  IL6 binding MRD
ELGGRKSMLIGQAGQGSFNEDCMWDPLLMDCAYSP

SEQ ID NO: 1490 - protein, 35 aa, Artificial Sequence
  IL6 binding MRD
EAWRELRWWNGQAGQGSFNEDCMWDPLLMDCAYSP

SEQ ID NO: 1491 - protein, 46 aa, Artificial Sequence
  IL6 binding MRD
YCTDRVDICMGQAGQGSATGGSGSTASSFNEDCMWDPLLMDCAYSP

SEQ ID NO: 1492 - protein, 35 aa, Artificial Sequence
  IL6 binding MRD
LIVPAPLTWWGQAGQGSFNEDCMWDPLLMDCAYSP

SEQ ID NO: 1493 - protein, 35 aa, Artificial Sequence
  IL6 binding MRD
WVPDMWMHEWGQAGQGSFNEDCMWDPLLMDCAYSP

SEQ ID NO: 1494 - protein, 41 aa, Artificial Sequence
  IL6 binding MRD
YQDSWITGMQGQAGQGSATGGSSFNEDCMWDPLLMDCAYSP

SEQ ID NO: 1495 - protein, 18 aa, Artificial Sequence
  IL6 binding MRD
YEEHCRLFPADWICSLLQ

SEQ ID NO: 1496 - protein, 42 aa, Artificial Sequence
  IL6 binding MRD
VCQDEVYMWCEGQAGQGSATGGSSFNEDCMWDPLLMDCAYSP

SEQ ID NO: 1497 - protein, 19 aa, Artificial Sequence
  IL6 binding MRD
ADSWCHTLYWNLRHCEIQE

SEQ ID NO: 1498 - protein, 41 aa, Artificial Sequence
  IL6 binding MRD
HHQQSMYWLEGQAGQGSATGGSSFNEDCMWDPLLMDCAYSP

SEQ ID NO: 1499 - protein, 35 aa, Artificial Sequence
  IL6 binding MRD
AEHTFALQYVGQAGQGSFNEDCMWDPLLMDCAYSP

SEQ ID NO: 1500 - protein, 41 aa, Artificial Sequence
  IL6 binding MRD
YTTYNWKPWQGQAGQGSATGGSSFNEDCMWDPLLMDCAYSP

SEQ ID NO: 1501 - protein, 46 aa, Artificial Sequence
  IL6 binding MRD
ACDTQHHGCMGQAGQGSATGGSGSTASSFNEDCMWDPLLMDCAYSP

SEQ ID NO: 1502 - protein, 35 aa, Artificial Sequence
  IL6 binding MRD
EVVGVGWFLNGQAGQGSFNEDCMWDPLLMDCAYSP

SEQ ID NO: 1503 - protein, 19 aa, Artificial Sequence
  IL6 binding MRD
PESWCHTLYWNLQHCLSQE

SEQ ID NO: 1504 - protein, 35 aa, Artificial Sequence
  IL6 binding MRD
IDNKYEGMVLGQAGQGSFNEDCMWDPLLMDCAYSP

SEQ ID NO: 1505 - protein, 41 aa, Artificial Sequence
  IL6 binding MRD
HWMTYQFWIQGQAGQGSATGGSSFNEDCMWDPLLMDCAYSP

SEQ ID NO: 1506 - protein, 42 aa, Artificial Sequence
  IL6 binding MRD
TCELMQAWTHLGQAGQGSATGGSSFNEDCMWDPLLMDCAYSP

SEQ ID NO: 1507 - protein, 41 aa, Artificial Sequence
  IL6 binding MRD
YYPQHIDHIMGQAGQGSATGGSSFNEDCMWDPLLMDCAYSP

SEQ ID NO: 1508 - protein, 35 aa, Artificial Sequence
  IL6 binding MRD
MPLDDQPFLEGQAGQGSFNEDCMWDPLLMDCAYSP

SEQ ID NO: 1509 - protein, 37 aa, Artificial Sequence
  IL6 binding MRD
HTEFQRLEWPQGSATGGSSFNEDCMWDPLLMDCAYSP

SEQ ID NO: 1510 - protein, 35 aa, Artificial Sequence
  IL6 binding MRD
IQWPSMMEIHGQAGQGSFNEDCMWDPLLMDCAYSP

SEQ ID NO: 1511 - protein, 35 aa, Artificial Sequence
  IL6 binding MRD
QTGWGPKYMWGQAGQGSFNEDCMWDPLLMDCAYSP

SEQ ID NO: 1512 - protein, 35 aa, Artificial Sequence
  IL6 binding MRD
QSHIHLEKWLGQAGQGSFNEDCMWDPLLMDCAYSP

SEQ ID NO: 1513 - protein, 43 aa, Artificial Sequence
  IL6 binding MRD
QCWIYPYDGLCNGQAGQGSATGGSSFNEDCMWDPLLMDCAYSP

SEQ ID NO: 1514 - protein, 36 aa, Artificial Sequence
  IL6 binding MRD
TCTHLVKTVLIGQAGQGSFNEDCMWDPLLMDCAYSP

SEQ ID NO: 1515 - protein, 46 aa, Artificial Sequence
  IL6 binding MRD
PLYTVWKWSGGQAGQGSATGGSGSTASSFNEDCMWDPLLMDCAYSP

SEQ ID NO: 1516 - protein, 31 aa, Artificial Sequence
  IL6 binding MRD
FNFERWEQKPQGSFNEDCMWDPLLMDCAYSP

SEQ ID NO: 1517 - protein, 35 aa, Artificial Sequence
  IL6 binding MRD
YVLQQVEMQEGQAGQGSFNEDCMWDPLLMDCAYSP

SEQ ID NO: 1518 - protein, 35 aa, Artificial Sequence
  IL6 binding MRD
SMTKYKALYHGQAGQGSFNEDCMWDPLLMDCAYSP

SEQ ID NO: 1519 - protein, 35 aa, Artificial Sequence
  IL6 binding MRD
QDNIAYQGWWGQAGQGSFNEDCMWDPLLMDCAYSP

SEQ ID NO: 1520 - protein, 41 aa, Artificial Sequence
  IL6 binding MRD
MDHIWQHGQLGQAGQGSATGGSSFNEDCMWDPLLMDCAYSP

SEQ ID NO: 1521 - protein, 51 aa, Artificial Sequence
  IL6 binding MRD
SCFGDLQICWGQAGQGSATGGSGSTASSGSGSSFNEDCMWDPLLMDCAYSP

SEQ ID NO: 1522 - protein, 36 aa, Artificial Sequence
  IL6 binding MRD
HCKDMHWAIQFGQAGQGSFNEDCMWDPLLMDCAYSP

SEQ ID NO: 1523 - protein, 41 aa, Artificial Sequence
  IL6 binding MRD
WLFVAEQSQYGQAGQGSATGGSSFNEDCMWDPLLMDCAYSP

SEQ ID NO: 1524 - protein, 19 aa, Artificial Sequence
  IL6 binding MRD
ANSWCHTLYWDLMYCVWQE

SEQ ID NO: 1525 - protein, 44 aa, Artificial Sequence
  IL6 binding MRD
DGSGFYPNKWFHGGQAGQGSATGGSSFNEDCMWDPLLMDCAYSP

SEQ ID NO: 1526 - protein, 51 aa, Artificial Sequence
  IL6 binding MRD
MVYRWVMQADGQAGQGSATGGSGSTASSGSGSSFNEDCMWDPLLMDCAYSP

SEQ ID NO: 1527 - protein, 35 aa, Artificial Sequence
  IL6 binding MRD
HPMEIKTMMKGQAGQGSFNEDCMWDPLLMDCAYSP

SEQ ID NO: 1528 - protein, 41 aa, Artificial Sequence
  IL6 binding MRD
LQAWMWQVNQGQAGQGSATGGSSFNEDCMWDPLLMDCAYSP

SEQ ID NO: 1529 - protein, 37 aa, Artificial Sequence
  IL6 binding MRD
GCNYFPTQWECYGQAGQGSFNEDCMWDPLLMDCAYSP

SEQ ID NO: 1530 - protein, 68 aa, Artificial Sequence
  IL6 binding MRD
LQAWMWQVNQGQAGQGSATGGSSFNEDCMWDPLLMDCAYSPQGSATGGSSFNEDCMWDPLLMDCAYSP

SEQ ID NO: 1531 - protein, 35 aa, Artificial Sequence
  IL6 binding MRD
QFPYESPPSIGQAGQGSFNEDCMWDPLLMDCAYSP

SEQ ID NO: 1532 - protein, 46 aa, Artificial Sequence
  IL6 binding MRD
IYLSWDMPALGQAGQGSATGGSGSTASSFNEDCMWDPLLMDCAYSP

SEQ ID NO: 1533 - protein, 46 aa, Artificial Sequence
  IL6 binding MRD
QYTEMVALVYGQAGQGSATGGSGSTASSFNEDCMWDPLLMDCAYSP

SEQ ID NO: 1534 - protein, 19 aa, Artificial Sequence
  IL6 binding MRD
PDSWCHTLYWHLQHCLSQE

SEQ ID NO: 1535 - protein, 41 aa, Artificial Sequence
  IL6 binding MRD
PAKDPFVMRHGQAGQGSATGGSSFNEDCMWDPLLMDCAYSP

SEQ ID NO: 1536 - protein, 41 aa, Artificial Sequence
  IL6 binding MRD
WQVSSVQLPYGQAGQGSATGGSSFNEDCMWDPLLMDCAYSP

SEQ ID NO: 1537 - protein, 35 aa, Artificial Sequence
  IL6 binding MRD
QQTQTYWGTWGQAGQGSFNEDCMWDPLLMDCAYSP

SEQ ID NO: 1538 - protein, 35 aa, Artificial Sequence
  IL6 binding MRD
DQLWRQNWMQGQAGQGSFNEDCMWDPLLMDCAYSP

SEQ ID NO: 1539 - protein, 41 aa, Artificial Sequence
  IL6 binding MRD
QYYNVYWQNQGQAGQGSATGGSSFNEDCMWDPLLMDCAYSP

SEQ ID NO: 1540 - protein, 31 aa, Artificial Sequence
  IL6 binding MRD
QTYSNKPMGPQGSFNEDCMWDPLLMDCAYSP

SEQ ID NO: 1541 - protein, 35 aa, Artificial Sequence
  IL6 binding MRD
EEEWSWYDRRGQAGQGSFNEDCMWDPLLMDCAYSP

SEQ ID NO: 1542 - protein, 42 aa, Artificial Sequence
  IL6 binding MRD
AYYWKEWMKMGQAGQGSATGGSSFNEDCMWDPLLMDCAYSPG

SEQ ID NO: 1543 - protein, 31 aa, Artificial Sequence
  IL6 binding MRD
AIAHLDVFPPQGSFNEDCMWDPLLMDCAYSP

SEQ ID NO: 1544 - protein, 56 aa, Artificial Sequence
  IL6 binding MRD
QYQSRQTFQIGQAGQGSFNEDCMWDPLLMDCAYSPQGSFNEDCMWDPLLMDCAYSP

SEQ ID NO: 1545 - protein, 84 aa, Artificial Sequence
  IL6 binding MRD
YWAWQQEFQWGQAGQGSATGGSSFNEDCMWDPLLMDCAYSPGSYWAWQQEFQWGQAGQGSATGGSSFNEDCMWDPLLMDCAYSP

SEQ ID NO: 1546 - protein, 41 aa, Artificial Sequence
  IL6 binding MRD
YYQGFPWFQIGQAGQGSATGGSSFNEDCMWDPLLMDCAYSP

SEQ ID NO: 1547 - protein, 35 aa, Artificial Sequence
  IL6 binding MRD
FFYQWSYGWSGQAGQGSFNEDCMWDPLLMDCAYSP

SEQ ID NO: 1548 - protein, 17 aa, Artificial Sequence
  IL6 binding MRD
YEEHCALFPTDWICTLH

SEQ ID NO: 1549 - protein, 41 aa, Artificial Sequence
  IL6 binding MRD
WRWHAEWDWYGQAGQGSATGGSSFNEDCMWDPLLMDCAYSP

SEQ ID NO: 1550 - protein, 41 aa, Artificial Sequence
  IL6 binding MRD
WRWEFGYYYHGQAGQGSATGGSSFNEDCMWDPLLMDCAYSP

SEQ ID NO: 1551 - protein, 35 aa, Artificial Sequence
  IL6 binding MRD
MFYEYQWWIHGQAGQGSFNEDCMWDPLLMDCAYSP

SEQ ID NO: 1552 - protein, 68 aa, Artificial Sequence
  IL6 binding MRD
PDWITWQPAWGQAGQGSATGGSSFNEDCMWDPLLMDCAYSPQGSATGGSSFNEDCMWDPLLMDCAYSP

SEQ ID NO: 1553 - protein, 41 aa, Artificial Sequence
  IL6 binding MRD
WPFYEYIIHMGQAGQGSATGGSSFNEDCMWDPLLMDCAYSP

SEQ ID NO: 1554 - protein, 41 aa, Artificial Sequence
  IL6 binding MRD
RPYYYQWHIWGQAGQGSATGGSSFNEDCMWDPLLMDCAYSP

SEQ ID NO: 1555 - protein, 41 aa, Artificial Sequence
  IL6 binding MRD
TGFFWSWSFGGQAGQGSATGGSSFNEDCMWDPLLMDCAYSP

SEQ ID NO: 1556 - protein, 68 aa, Artificial Sequence
  IL6 binding MRD
SKMEQYPWNMGQAGQGSATGGSSFNEDCMWDPLLMDCAYSPQGSATGGSSFNEDCMWDPLLMDCAYSP

SEQ ID NO: 1557 - protein, 68 aa, Artificial Sequence
  IL6 binding MRD
YHWQQQHQYHGQAGQGSATGGSSFNEDCMWDPLLMDCAYSPQGSATGGSSFNEDCMWDPLLMDCAYSP

SEQ ID NO: 1558 - protein, 88 aa, Artificial Sequence
  IL6 binding MRD
DWQVYYKTWIGQAGQGSATGGSGSTASSGSGSSFNEDCMWDPLLMDCAYSPQGSATGGSGSTASSGSGSSFNEDCMWDPLLMDCAYSP

SEQ ID NO: 1559 - protein, 46 aa, Artificial Sequence
  IL6 binding MRD
YRYTTYWWYSGQAGQGSATGGSGSTASSFNEDCMWDPLLMDCAYSP

SEQ ID NO: 1560 - protein, 96 aa, Artificial Sequence
  IL6 binding MRD
QCCMSQVSWYVGQAGQGSATGGSSFNEDCMWDPLLMDCAYSPQGSATGGSSFNEDCMWDPLLMDCAYSPQGSATGGSSFNEDCMWDPLLMDCAYSP

SEQ ID NO: 1561 - protein, 86 aa, Artificial Sequence
  IL6 binding MRD
YYQGFPWFQIGQAGQGSATGGSSFNEDCMWDPLLMDCAYSPGGGSYYQGFPWFQIGQAGQGSATGGSSFNEDCMWDPLLMDCAYSP

SEQ ID NO: 1562 - protein, 41 aa, Artificial Sequence
  IL6 binding MRD
QWSFHWWSHTGQAGQGSATGGSSFNEDCMWDPLLMDCAYSP

SEQ ID NO: 1563 - protein, 41 aa, Artificial Sequence
  IL6 binding MRD
WTFEWWIYTKGQAGQGSATGGSSFNEDCMWDPLLMDCAYSP

SEQ ID NO: 1564 - protein, 68 aa, Artificial Sequence
  IL6 binding MRD
ADRFFVWNPYGQAGQGSATGGSSFNEDCMWDPLLMDCAYSPQGSATGGSSFNEDCMWDPLLMDCAYSP

SEQ ID NO: 1565 - protein, 68 aa, Artificial Sequence
  IL6 binding MRD
QRYMMQTMLIGQAGQGSATGGSSFNEDCMWDPLLMDCAYSPQGSATGGSSFNEDCMWDPLLMDCAYSP

SEQ ID NO: 1566 - protein, 110 aa, Artificial Sequence
  IL6 binding MRD
PWSKATQPGWGQAGQGSATGGSGSTASSFNEDCMWDPLLMDCAYSPQGSATGGSGSTASSFNEDCMWDPLLMDCAYSPQGSATGGSGSTASSFNEDCMWDPLLMDCAYSP

SEQ ID NO: 1567 - protein, 41 aa, Artificial Sequence
  IL6 binding MRD
IWWGYSWDHYGQAGQGSATGGSSFNEDCMWDPLLMDCAYSP

SEQ ID NO: 1568 - protein, 35 aa, Artificial Sequence
  IL6 binding MRD
IVNFTWNFLSGQAGQGSFNEDCMWDPLLMDCAYSP

SEQ ID NO: 1569 - protein, 103 aa, Artificial Sequence
  IL6 binding MRD
MQFSWTQHFFGQAGQGSATGGSGSTASSGSGSSFNEDCMWDPLLMDCAYSPGMQFSWTQHFFGQAGQGSATGGSGSTASSGSGSSFNEDCMWDPLLMDCAYSP

SEQ ID NO: 1570 - protein, 41 aa, Artificial Sequence
  IL6 binding MRD
LHANSIATNWGQAGQGSATGGSSFNEDCMWDPLLMDCAYSP

SEQ ID NO: 1571 - protein, 19 aa, Artificial Sequence
  IL6 binding MRD
PDSWCHTLYWQLIHCERQE

SEQ ID NO: 1572 - protein, 41 aa, Artificial Sequence
  IL6 binding MRD
QFPYESPPSIGQAGQGSATGGSSFNEDCMWDPLLMDCAYSP

SEQ ID NO: 1573 - protein, 131 aa, Artificial Sequence
  IL6 binding MRD
YYQGFPWFQIGQAGQGSATGGSSFNEDCMWDPLLMDCAYSPGGGSYYQGFPWFQIGQAGQGSATGGSSFNEDCMWDPLLMDCAYSPGGGSYYQGFPWFQIGQAGQGSATGGSSFNEDCMWDPLLMDCAYSP

SEQ ID NO: 1574 - protein, 86 aa, Artificial Sequence; identical to SEQ ID NO: 1561
  IL6 binding MRD

SEQ ID NO: 1575 - protein, 20 aa, Artificial Sequence
  IL6 binding MRD
GEAWCWDPIRMDVRVCSVFI

SEQ ID NO: 1576 - protein, 18 aa, Artificial Sequence
  IL6 binding MRD
GPYSCPWDPMKMECAYSP

SEQ ID NO: 1577 - protein, 18 aa, Artificial Sequence
  IL6 binding MRD
EYSSCNWDPLLMQCQRVV

SEQ ID NO: 1578 - protein, 18 aa, Artificial Sequence
  IL6 binding MRD
FHSTCFWDPLLMRCVSAP

SEQ ID NO: 1579 - protein, 18 aa, Artificial Sequence
  IL6 binding MRD
SVSPCIWDPLLMMCGNYS

SEQ ID NO: 1580 - protein, 18 aa, Artificial Sequence
  IL6 binding MRD
VGVDCPWDPLMMECAGRN

SEQ ID NO: 1581 - protein, 18 aa, Artificial Sequence
  IL6 binding MRD
VSAECYWDPLMMQCSTDM

SEQ ID NO: 1582 - protein, 19 aa, Artificial Sequence
  IL6 binding MRD
FGDTCFWHPFNEDMCESKP

SEQ ID NO: 1583 - protein, 18 aa, Artificial Sequence
  IL6 binding MRD
QWLHCFWDPLMMKCVTVS

SEQ ID NO: 1584 - protein, 18 aa, Artificial Sequence
  IL6 binding MRD
TPHPCHWDPMIMYCMLEM

SEQ ID NO: 1585 - protein, 18 aa, Artificial Sequence
  IL6 binding MRD
HEEDCWWDPLIMQCFNRT

SEQ ID NO: 1586 - protein, 18 aa, Artificial Sequence
  IL6 binding MRD
HTANCPWDPLIMNCSFQS

SEQ ID NO: 1587 - protein, 18 aa, Artificial Sequence
  IL6 binding MRD
YTKHCQRLPTYKICNLFM

SEQ ID NO: 1588 - protein, 19 aa, Artificial Sequence
  IL6 binding MRD
ADSWCHTLYWQLQHCLSQE

SEQ ID NO: 1589 - protein, 20 aa, Artificial Sequence
  IL6 binding MRD
HSRWCYWEPIRMIEMCMGDK

SEQ ID NO: 1590 - protein, 18 aa, Artificial Sequence
  IL6 binding MRD
PGVACFWDPLLMSCSYDE

SEQ ID NO: 1591 - protein, 18 aa, Artificial Sequence
  IL6 binding MRD
RAFTCPWDPLIMDCAGAS

SEQ ID NO: 1592 - protein, 18 aa, Artificial Sequence
  IL6 binding MRD
GDDWCAWDPIRMQCSYTK

SEQ ID NO: 1593 - protein, 20 aa, Artificial Sequence
  IL6 binding MRD
EIEQCWWDPMLMEGVCWPSI

SEQ ID NO: 1594 - protein, 18 aa, Artificial Sequence
  IL6 binding MRD
HGRSCAWDPLKMDCVWYH

SEQ ID NO: 1595 - protein, 18 aa, Artificial Sequence
  IL6 binding MRD
RLGACVWDPLMMQCAWIS

SEQ ID NO: 1596 - protein, 18 aa, Artificial Sequence
  IL6 binding MRD
LYPSCPWDPILMQCSALK

SEQ ID NO: 1597 - protein, 18 aa, Artificial Sequence
  IL6 binding MRD
PTPLCHWDPLLMHCTASD

SEQ ID NO: 1598 - protein, 19 aa, Artificial Sequence
  IL6 binding MRD
TDSWCHTLYWQLHHCAILE

SEQ ID NO: 1599 - protein, 18 aa, Artificial Sequence
  IL6 binding MRD
RWNVCAWDPLLMQCASAP

SEQ ID NO: 1600 - protein, 18 aa, Artificial Sequence
  IL6 binding MRD
MSVSCNWDPLLMTCRLPT

SEQ ID NO: 1601 - protein, 18 aa, Artificial Sequence
  IL6 binding MRD
PGLRCPWDPLMMTCVAHP

SEQ ID NO: 1602 - protein, 18 aa, Artificial Sequence
  IL6 binding MRD
QIAFCLWDPLLMDCTVQT

SEQ ID NO: 1603 - protein, 18 aa, Artificial Sequence
  IL6 binding MRD
SPQECPWDPIAMKCAFVR

SEQ ID NO: 1604 - protein, 18 aa, Artificial Sequence
  IL6 binding MRD
TSHPCWWDPIMMSCWLEE

SEQ ID NO: 1605 - protein, 18 aa, Artificial Sequence
  IL6 binding MRD
VQLYCIWDPLMMDCGQRS

SEQ ID NO: 1606 - protein, 18 aa, Artificial Sequence
  IL6 binding MRD
CRNSCHWDPLIMDCMQEM

SEQ ID NO: 1607 - protein, 38 aa, Artificial Sequence
  IL6 binding MRD
FNEDCMWDPLLMDCAYSPGQGSAAGGGSIVQHQPSRMY

SEQ ID NO: 1608 - protein, 35 aa, Artificial Sequence
  IL6 binding MRD
FNEDCMWDPLLMDCAYSPAGGGSICQATPYSPWCR

SEQ ID NO: 1609 - protein, 19 aa, Artificial Sequence
  IL6 binding MRD
HRAPCFSCTACRQPCFSLT

SEQ ID NO: 1610 - protein, 37 aa, Artificial Sequence
  IL6 binding MRD
FNEDCMWDPLLMDCAYSPAGGSALRMCDSWVENRCLG

SEQ ID NO: 1611 - protein, 47 aa, Artificial Sequence
  IL6 binding MRD
FNEDCMWDPLLMDCAYSPGQGSAAGGSAQWQCHINPTGMACVDMLQG

SEQ ID NO: 1612 - protein, 38 aa, Artificial Sequence
  IL6 binding MRD
FNEDCMWDPLLMDCAYSPGQGSAAGGGSHPWRHNMQKI

SEQ ID NO: 1613 - protein, 38 aa, Artificial Sequence
  IL6 binding MRD
FNEDCMWDPLLMDCAYSPGQGSAAGGGSQFPYESPPSI

SEQ ID NO: 1614 - protein, 33 aa, Artificial Sequence
  IL6 binding MRD
FNEDCMWDPLLMDCAYSPAGGGSVCPTQPANCQ

SEQ ID NO: 1615 - protein, 40 aa, Artificial Sequence
  IL6 binding MRD
FNEDCMWDPLLMDCAYSPGQGSAAGGGSPCRFWPGRAFCH

SEQ ID NO: 1616 - protein, 45 aa, Artificial Sequence
  IL6 binding MRD
FNEDCMWDPLLMDCAYSPGQGSATGGSAAGGGSECELDYHMVWCK

SEQ ID NO: 1617 - protein, 38 aa, Artificial Sequence
  IL6 binding MRD
FNEDCMWDPLLMDCAYSPGQGSAAGGGSFWMQQAQQHK

SEQ ID NO: 1618 - protein, 38 aa, Artificial Sequence
  IL6 binding MRD
FNEDCMWDPLLMDCAYSPGQGSAAGGGSKCDWQPWFCP

SEQ ID NO: 1619 - protein, 34 aa, Artificial Sequence
  IL6 binding MRD
FNEDCMWDPLLMDCAYSPAGGGSFVGESQYMQTK

SEQ ID NO: 1620 - protein, 48 aa, Artificial Sequence
  IL6 binding MRD
FNEDCMWDPLLMDCAYSPGQGSATGGSGSTASAAGGGSQPWRHNMQKI

SEQ ID NO: 1621 - protein, 48 aa, Artificial Sequence
  IL6 binding MRD
FNEDCMWDPLLMDCAYSPGQGSATGGSGSTASAAGGGSQFPYESPPSI

SEQ ID NO: 1622 - protein, 38 aa, Artificial Sequence
  IL6 binding MRD
FNEDCMWDPLLMDCAYSPGRGSSLGGVSPPIVSGRASA

SEQ ID NO: 1623 - protein, 19 aa, Artificial Sequence
  IL6 binding MRD
ANSWCHTLYWQLHHCEILE

SEQ ID NO: 1624 - protein, 33 aa, Artificial Sequence
  IL6 binding MRD
FNEDCMWDPLLMDCAYSPAGGGSIWQTEVIVPD

SEQ ID NO: 1625 - protein, 48 aa, Artificial Sequence
  IL6 binding MRD
FNEDCMWDPLLMDCAYSPGQGSATGGSGSTASAAGGGSRVRLDHWEQV

SEQ ID NO: 1626 - protein, 43 aa, Artificial Sequence
  IL6 binding MRD
FNEDCMWDPLLMDCAYSPGQGSATGGSAAGDGSIEHHGAWSAQ

SEQ ID NO: 1627 - protein, 46 aa, Artificial Sequence
  IL6 binding MRD
FNEDCMWDPLLMDCAYSPGQGSAAGGSPVLGCRNVHNTQCRLWFQG

SEQ ID NO: 1628 - protein, 19 aa, Artificial Sequence
  IL6 binding MRD
GLHGCQYVQMFFHFCAPKT

SEQ ID NO: 1629 - protein, 51 aa, Artificial Sequence
  IL6 binding MRD
FNEDCMWDPLLMDCAYSPGQGSATGGSAAGGSHWERCVPHSDPDYNCSFDS

SEQ ID NO: 1630 - protein, 38 aa, Artificial Sequence
  IL6 binding MRD
FNEDCMWDPLLMDCAYSPAGGSGWVFRCKNMPCAKAEH

SEQ ID NO: 1631 - protein, 38 aa, Artificial Sequence
  IL6 binding MRD
FNEDCMWDPLLMDCAYSPGQGSAAGGGSPPHPSNSIWR

SEQ ID NO: 1632 - protein, 50 aa, Artificial Sequence
  IL6 binding MRD
FNEDCMWDPLLMDCAYSPGQGSATGGSAAGGSRLSLHCPEHPCGSSWTQG

SEQ ID NO: 1633 - protein, 33 aa, Artificial Sequence
  IL6 binding MRD
FNEDCMWDPLLMDCAYSPAGGGSPDWITWQPAW

SEQ ID NO: 1634 - protein, 18 aa, Artificial Sequence
  IL6 binding MRD
FQGHCALFPTDWICTLKS

SEQ ID NO: 1635 - protein, 48 aa, Artificial Sequence
  IL6 binding MRD
FNEDCMWDPLLMDCAYSPGQGSAAGGSVGLLCQDFAYGQTHCDVLQQG

SEQ ID NO: 1636 - protein, 40 aa, Artificial Sequence
  IL6 binding MRD
FNEDCMWDPLLMDCAYSPGQGSAAGDGSMCYQEPHFTYCP

SEQ ID NO: 1637 - protein, 38 aa, Artificial Sequence
  IL6 binding MRD
FNEDCMWDPLLMDCAYSPGQGSAAGGGSECMSSWHGCT

SEQ ID NO: 1638 - protein, 57 aa, Artificial Sequence
  IL6 binding MRD
FNEDCMWDPLLMDCAYSPGQGSATGGSGSTASAAGGSDAWGCLDDFFMKVAGCKTLF

SEQ ID NO: 1639 - protein, 44 aa, Artificial Sequence
  IL6 binding MRD
FNEDCMWDPLLMDCAYSPGQGSAAGGSQFLLCNGSEWCPANRQG

SEQ ID NO: 1640 - protein, 39 aa, Artificial Sequence
  IL6 binding MRD
FNEDCMWDPLLMDCAYSPGQGSAAGGGSFCMWPFCIPPR

SEQ ID NO: 1641 - protein, 38 aa, Artificial Sequence
  IL6 binding MRD
FNEDCMWDPLLMDCAYSPGQGSAAGGGSMGGEDDIWHQ

SEQ ID NO: 1642 - protein, 19 aa, Artificial Sequence
  IL6 binding MRD
PDSRCHTLYWALRYCAYQE

SEQ ID NO: 1643 - protein, 43 aa, Artificial Sequence
  IL6 binding MRD
FNEDCMWDPLLMDCAYSPGQGSATGGSAAGGGSWHSYTAMYAD

SEQ ID NO: 1644 - protein, 38 aa, Artificial Sequence
  IL6 binding MRD
FNEDCMWDPLLMDCAYSPGQGSAAGGGSGMVSHWKKVQ

SEQ ID NO: 1645 - protein, 54 aa, Artificial Sequence
  IL6 binding MRD
FNEDCMWDPLLMDCAYSPGQGSATGGSGSTASAAGGSQGMPCQYHAMQLCPPSR

SEQ ID NO: 1646 - protein, 48 aa, Artificial Sequence
  IL6 binding MRD
FNEDCMWDPLLMDCAYSPGQGSATGGSGSTASAAGGGSHQHNFQLRYT

SEQ ID NO: 1647 - protein, 40 aa, Artificial Sequence
  IL6 binding MRD
FNEDCMWDPLLMDCAYSPGQGSAAGGGSLCDQWQSARYCV

SEQ ID NO: 1648 - protein, 18 aa, Artificial Sequence
  IL6 binding MRD
FNEDCMWDPLLMDCAYSP

SEQ ID NO: 1649 - protein, 40 aa, Artificial Sequence
  IL6 binding MRD
FNEDCMWDPLLMDCAYSPGQGSAAGGGSYCHEDPRSLDCR

SEQ ID NO: 1650 - protein, 38 aa, Artificial Sequence
  IL6 binding MRD
FNEDCMWDPLLMDCAYSPGQGSAAGGGSHPWRHNMHKI

SEQ ID NO: 1651 - protein, 47 aa, Artificial Sequence
  IL6 binding MRD
FNEDCMWDPLLMDCAYSPGQGSAAGGSPLVDCLTYPEWVNCPRTIQG

SEQ ID NO: 1652 - protein, 40 aa, Artificial Sequence
  IL6 binding MRD
FNEDCMWDPLLMDCAYSPGQGSAAGGGSDCNFAPKETNCW

SEQ ID NO: 1653 - protein, 54 aa, Artificial Sequence
  IL6 binding MRD
FNEDCMWDPLLMDCAYSPGQGSATGGSGSTASAAGGSKTLFCGYDGYDMCDLSA

SEQ ID NO: 1654 - protein, 38 aa, Artificial Sequence
  IL6 binding MRD
FNEDCMWDPLLMDCAYSPGQGSAAGGGSWNRHPPPSGQ

SEQ ID NO: 1655 - protein, 33 aa, Artificial Sequence
  IL6 binding MRD
FNEDCMWDPLLMDCAYSPAGGGSMQYHPWQDMW

SEQ ID NO: 1656 - protein, 40 aa, Artificial Sequence
  IL6 binding MRD
FNEDCMWDPLLMDCAYSPGQGSAAGGGSSCNITDQMGVCL

SEQ ID NO: 1657 - protein, 54 aa, Artificial Sequence
  IL6 binding MRD
FNEDCMWDPLLMDCAYSPGQGSATGGSAAGGSWDDTCNAEVYQQGLMCDTRVQG

SEQ ID NO: 1658 - protein, 44 aa, Artificial Sequence
  IL6 binding MRD
FNEDCMWDPLLMDCAYSPGQGSAAGGSARRGCVMLNECSSVSQG

SEQ ID NO: 1659 - protein, 45 aa, Artificial Sequence
  IL6 binding MRD
FNEDCMWDPLLMDCAYSPGQGSAAGGSRMRSVCPHHVCWRGVPQG

SEQ ID NO: 1660 - protein, 40 aa, Artificial Sequence
  IL6 binding MRD
FNEDCMWDPLLMDCAYSPAGGSPKSECVAPLEMIECPSLW

SEQ ID NO: 1661 - protein, 44 aa, Artificial Sequence
  IL6 binding MRD
FNEDCMWDPLLMDCAYSPGQGSAAGGSSVFWCYSQHGCALTSQG

SEQ ID NO: 1662 - protein, 38 aa, Artificial Sequence
  IL6 binding MRD
FNEDCMWDPLLMDCAYSPGQGSAAGGGSPRAWQFPVSS

SEQ ID NO: 1663 - protein, 45 aa, Artificial Sequence
  IL6 binding MRD
FNEDCMWDPLLMDCAYSPGQGSATGGSAAGGGSICMEYPIIRPCT

SEQ ID NO: 1664 - protein, 39 aa, Artificial Sequence
  IL6 binding MRD
FNEDCMWDPLLMDCAYSPGQGSAAGGGSPCLSWYVAPMF

SEQ ID NO: 1665 - protein, 48 aa, Artificial Sequence
  IL6 binding MRD
FNEDCMWDPLLMDCAYSPGQGSAAGGSADDCCVSHLPFIGYCGFVRQG

SEQ ID NO: 1666 - protein, 56 aa, Artificial Sequence
  IL6 binding MRD
FNEDCMWDPLLMDCAYSPGQGSATGGSGSTASAAGGSGEDQCKLFGSGLDTCIPYV

SEQ ID NO: 1667 - protein, 40 aa, Artificial Sequence
  IL6 binding MRD
FNEDCMWDPLLMDCAYSPGQGSAAGGGSPCVKAPEFDWCT

SEQ ID NO: 1668 - protein, 45 aa, Artificial Sequence
  IL6 binding MRD
FNEDCMWDPLLMDCAYSPGQGSAAGGSHESCAVHYQHGCPYASQG

SEQ ID NO: 1669 - protein, 52 aa, Artificial Sequence
  IL6 binding MRD
FNEDCMWDPLLMDCAYSPGQGSATGGSGSTASAAGNCSCFIKPVGPDCWAVS

SEQ ID NO: 1670 - protein, 101 aa, Artificial Sequence
  IL6 binding MRD
QAASAPASEPPGSLCLPDQFRCGNGQCIPLDWVCDGVNDCPDDSDEEGCPPRTCAPSQFQCGSGYCISQRWVCDGENDCEDGSDEANCAGSVPTCPSDEFR

SEQ ID NO: 1671 - protein, 38 aa, Artificial Sequence
  IL6 binding MRD
FNEDCMWDPLLMDCAYSPGQGSAAGGGSEEQPTEWHVY

SEQ ID NO: 1672 - protein, 39 aa, Artificial Sequence
  IL6 binding MRD
FNEDCMWDPLLMDCAYSPAGGSETFDCNTPWEHECYGRF

SEQ ID NO: 1673 - protein, 51 aa, Artificial Sequence
  IL6 binding MRD
FNEDCMWDPLLMDCAYSPGQGSATGGSAAGGSETLPCQYWGQSWCSQSAQG

SEQ ID NO: 1674 - protein, 50 aa, Artificial Sequence
  IL6 binding MRD
FNEDCMWDPLLMDCAYSPGQGSATGGSGSTASAAGGGSPCTPWTEWQQCP

SEQ ID NO: 1675 - protein, 44 aa, Artificial Sequence
  IL6 binding MRD
FNEDCMWDPLLMDCAYSPGQGSAAGGSHSMLCQPWHLCPPAQQG

SEQ ID NO: 1676 - protein, 48 aa, Artificial Sequence
  IL6 binding MRD
FNEDCMWDPLLMDCAYSPGQGSATGGSGSTASAAGGGSKCSIDVQQCM

SEQ ID NO: 1677 - protein, 38 aa, Artificial Sequence
  IL6 binding MRD
FNEDCMWDPLLMDCAYSPGQGSAAGGGSQPWRHNMQKI

SEQ ID NO: 1678 - protein, 43 aa, Artificial Sequence
  IL6 binding MRD
FNEDCMWDPLLMDCAYSPGQGSATGGSAAGGGSHHKNNGTIYQ

SEQ ID NO: 1679 - protein, 38 aa, Artificial Sequence
  IL6 binding MRD
FNEDCMWDPLLMDCAYSPGQGSAAGGGSPAERMKMHMF

SEQ ID NO: 1680 - protein, 38 aa, Artificial Sequence
  IL6 binding MRD
FNEDCMWDPLLMDCAYSPGQGSAAGGGSREFTQNWSIY

SEQ ID NO: 1681 - protein, 48 aa, Artificial Sequence
  IL6 binding MRD
FNEDCMWDPLLMDCAYSPGQGSATGGSGSTASAAGGGSAYTMWQYHKF

SEQ ID NO: 1682 - protein, 38 aa, Artificial Sequence
  IL6 binding MRD
FNEDCMWDPLLMDCAYSPGQGSAAGGGSYMGQIPAHNI

SEQ ID NO: 1683 - protein, 45 aa, Artificial Sequence
  IL6 binding MRD
FNEDCMWDPLLMDCAYSPGQGSATGGSAAGGGSKCWSFSGNRPCP

SEQ ID NO: 1684 - protein, 38 aa, Artificial Sequence
  IL6 binding MRD
FNEDCMWDPLLMDCAYSPGQGSAAGGGSPDWITWQPAW

SEQ ID NO: 1685 - protein, 51 aa, Artificial Sequence
  IL6 binding MRD
FNEDCMWDPLLMDCAYSPGQGSATGGSAAGGSYQPGCAQWWDMERGCFITQ

SEQ ID NO: 1686 - protein, 38 aa, Artificial Sequence
  IL6 binding MRD
FNEDCMWDPLLMDCAYSPGQGSAAGGGSSYWEHGWPWQ

SEQ ID NO: 1687 - protein, 38 aa, Artificial Sequence
  IL6 binding MRD
FNEDCMWDPLLMDCAYSPGQGSAAGGGSWPSPPWKQMV

SEQ ID NO: 1688 - protein, 33 aa, Artificial Sequence
  IL6 binding MRD
FNEDCMWDPLLMDCAYSPAGGGSDEFQFGSEMM

SEQ ID NO: 1689 - protein, 38 aa, Artificial Sequence
  IL6 binding MRD
FNEDCMWDPLLMDCAYSPGQGSAAGGGSINALGVAVQH

SEQ ID NO: 1690 - protein, 38 aa, Artificial Sequence
  IL6 binding MRD
FNEDCMWDPLLMDCAYSPGQGSAAGGGSQWQWKIHPAE

SEQ ID NO: 1691 - protein, 39 aa, Artificial Sequence
  IL6 binding MRD
FNEDCMWDPLLMDCAYSPGQGSAAGGGSLCERPLHTPWA

SEQ ID NO: 1692 - protein, 38 aa, Artificial Sequence
  IL6 binding MRD
FNEDCMWDPLLMDCAYSPGQGSAAGGGSPWAKNRHEAV

SEQ ID NO: 1693 - protein, 33 aa, Artificial Sequence
  IL6 binding MRD
FNEDCMWDPLLMDCAYSPAGGGSQPWRHNMQKI

SEQ ID NO: 1694 - protein, 38 aa, Artificial Sequence
  IL6 binding MRD
FNEDCMWDPLLMDCAYSPAGGSIRGLSCWPQDCGLEEL

SEQ ID NO: 1695 - protein, 38 aa, Artificial Sequence
  IL6 binding MRD
FNEDCMWDPLLMDCAYSPGQGSAAGGGSLNFGSYSTPH

SEQ ID NO: 1696 - protein, 38 aa, Artificial Sequence
  IL6 binding MRD
FNEDCMWDPLLMDCAYSPGQGSAAGGGSHYLWQEKTYK

SEQ ID NO: 1697 - protein, 48 aa, Artificial Sequence
  IL6 binding MRD
FNEDCMWDPLLMDCAYSPGQGSATGGSGSTASAAGGGSDCGANHEHCS

SEQ ID NO: 1698 - protein, 48 aa, Artificial Sequence
  IL6 binding MRD
FNEDCMWDPLLMDCAYSPGQGSATGGSGSTASAAGGGSRVQIIVPEKW

SEQ ID NO: 1699 - protein, 38 aa, Artificial Sequence
  IL6 binding MRD
FNEDCMWDPLLMDCAYSPGQGSAAGGGSEHHWEHPTNF

SEQ ID NO: 1700 - protein, 49 aa, Artificial Sequence
  IL6 binding MRD
FNEDCMWDPLLMDCAYSPGQGSATGGSAAGGSSAHDCTEESWCWMEVQG

SEQ ID NO: 1701 - protein, 52 aa, Artificial Sequence
  IL6 binding MRD
FNEDCMWDPLLMDCAYSPGQGSATGGSAAGGSYSFRCDVEPHQPGCFDLIQG

SEQ ID NO: 1702 - protein, 38 aa, Artificial Sequence
  IL6 binding MRD
FNEDCMWDPLLMDCAYSPGQGSAAGGGSLMYMWEPRTQ

SEQ ID NO: 1703 - protein, 44 aa, Artificial Sequence
  IL6 binding MRD
FNEDCMWDPLLMDCAYSPGQGSAAGGSLEASCAQSDQCFRQSQG

SEQ ID NO: 1704 - protein, 50 aa, Artificial Sequence
  IL6 binding MRD
FNEDCMWDPLLMDCAYSPGQGSATGGSGSTASAAGGGSLCFSNWDEMKCF

SEQ ID NO: 1705 - protein, 45 aa, Artificial Sequence
  IL6 binding MRD
FNEDCMWDPLLMDCAYSPGQGSATGGSAAGGGSICNWEEVDPHCA

SEQ ID NO: 1706 - protein, 38 aa, Artificial Sequence
  IL6 binding MRD
FNEDCMWDPLLMDCAYSPGQGSAAGGGSPWLDPQWDIW

SEQ ID NO: 1707 - protein, 38 aa, Artificial Sequence
  IL6 binding MRD
FNEDCMWDPLLMDCAYSPAGGSRNSWICMEWHCSDLTR

SEQ ID NO: 1708 - protein, 43 aa, Artificial Sequence
  IL6 binding MRD
FNEDCMWDPLLMDCAYSPGQGSATGGSAAGGGSWGYQQSWVQQ

SEQ ID NO: 1709 - protein, 50 aa, Artificial Sequence
  IL6 binding MRD
FNEDCMWDPLLMDCAYSPGQGSATGGSAAGGSLTVSNCQEEICMQDEYQG

SEQ ID NO: 1710 - protein, 38 aa, Artificial Sequence
  IL6 binding MRD
FNEDCMWDPLLMDCAYSPGQGSAAGGGSQCKAYMPQCA

SEQ ID NO: 1711 - protein, 33 aa, Artificial Sequence
  IL6 binding MRD
FNEDCMWDPLLMDCAYSPAGGGSSWQRHDGHQI

SEQ ID NO: 1712 - protein, 43 aa, Artificial Sequence
  IL6 binding MRD
FNEDCMWDPLLMDCAYSPGQGSATGGSAAGGGSTREMLVHPRH

SEQ ID NO: 1713 - protein, 48 aa, Artificial Sequence
  IL6 binding MRD
FNEDCMWDPLLMDCAYSPGQGSATGGSGSTASAAGGGSQQKERISPWP

SEQ ID NO: 1714 - protein, 38 aa, Artificial Sequence
  IL6 binding MRD
FNEDCMWDPLLMDCAYSPGQGSAAGGGSFNINNIYVGN

SEQ ID NO: 1715 - protein, 38 aa, Artificial Sequence
  IL6 binding MRD
FNEDCMWDPLLMDCAYSPGQGSAAGGGSVSSYNPWIIY

SEQ ID NO: 1716 - protein, 49 aa, Artificial Sequence
  IL6 binding MRD
FNEDCMWDPLLMDCAYSPGQGSAAGGSMQTSCEFHEKYERHGCQQLSQG

SEQ ID NO: 1717 - protein, 38 aa, Artificial Sequence
  IL6 binding MRD
FNEDCMWDPLLMDCAYSPGQGSAAGGGSNCLIAEWECE

SEQ ID NO: 1718 - protein, 48 aa, Artificial Sequence
  IL6 binding MRD
FNEDCMWDPLLMDCAYSPGQGSAAGGGSWEVPRSLWGQGQAGPGGGSG

SEQ ID NO: 1719 - protein, 54 aa, Artificial Sequence
  IL6 binding MRD
FNEDCMWDPLLMDCAYSPGQGSATGGSGSTASAAGGSMSLECESYGIGWCSLLH

SEQ ID NO: 1720 - protein, 48 aa, Artificial Sequence
  IL6 binding MRD
FNEDCMWDPLLMDCAYSPGQGSAAGGSHISTCKLIMGAYAHCQTPSQG

SEQ ID NO: 1721 - protein, 38 aa, Artificial Sequence
  IL6 binding MRD
FNEDCMWDPLLMDCAYSPGQGSAAGGGSLQQGRRHHMR

SEQ ID NO: 1722 - protein, 45 aa, Artificial Sequence
  IL6 binding MRD
FNEDCMWDPLLMDCAYSPGQGSAAGGSNIDFQCYPFKCGVLFSQG

SEQ ID NO: 1723 - protein, 40 aa, Artificial Sequence
  IL6 binding MRD
FNEDCMWDPLLMDCAYSPGQGSAAGGGSGCSSTPFAWSCS

SEQ ID NO: 1724 - protein, 50 aa, Artificial Sequence
  IL6 binding MRD
FNEDCMWDPLLMDCAYSPGQGSATGGSGSTASAAGGGSPCQNQPSYQVCT

SEQ ID NO: 1725 - protein, 52 aa, Artificial Sequence
  IL6 binding MRD
FNEDCMWDPLLMDCAYSPGQGSATGGSAAGGSLRQSCYPIPESEKCSFSNQG

SEQ ID NO: 1726 - protein, 38 aa, Artificial Sequence
  IL6 binding MRD
FNEDCMWDPLLMDCAYSPGQGSAAGGGSFFHWPTKAKE

SEQ ID NO: 1727 - protein, 43 aa, Artificial Sequence
  IL6 binding MRD
FNEDCMWDPLLMDCAYSPGQGSATGGSAAGGGSQCEFEQEECW

SEQ ID NO: 1728 - protein, 52 aa, Artificial Sequence
  IL6 binding MRD
FNEDCMWDPLLMDCAYSPGQGSATGGSAAGGSGVTGCSGFPTTGTCSQHEQG

SEQ ID NO: 1729 - protein, 43 aa, Artificial Sequence
  IL6 binding MRD
FNEDCMWDPLLMDCAYSPGQGSATGGSAAGGGSLDYHDIPRHA

SEQ ID NO: 1730 - protein, 43 aa, Artificial Sequence
  IL6 binding MRD
FNEDCMWDPLLMDCAYSPGQGSATGGSAAGGGSSGWEHSSIVF

SEQ ID NO: 1731 - protein, 38 aa, Artificial Sequence
  IL6 binding MRD
FNEDCMWDPLLMDCAYSPGQGSAAGGGSWWSPAYGWQN

SEQ ID NO: 1732 - protein, 40 aa, Artificial Sequence
  IL6 binding MRD
FNEDCMWDPLLMDCAYSPGQGSAAGGGSQCALKSFTVPCN

SEQ ID NO: 1733 - protein, 12 aa, Artificial Sequence
  ILB394
YCPWDPIMMQCA

SEQ ID NO: 1734 - protein, 18 aa, Artificial Sequence
  ILB227
LSNSCAWDPLLMNCIDTH

SEQ ID NO: 1735 - protein, 18 aa, Artificial Sequence
  ILB915
FNEDCMWDPLLMDCAYSP

SEQ ID NO: 1736 - protein, 18 aa, Artificial Sequence
  ILB235
INNLSPVCYWDPLLMDCI

SEQ ID NO: 1737 - protein, 35 aa, Artificial Sequence
  ILB914
VQYWEFETWEGQAGQGSFNEDCMWDPLLMDCAYSP

SEQ ID NO: 1738 - protein, 35 aa, Artificial Sequence
  ILB910
HQADDPFGQWGQAGQGSFNEDCMWDPLLMDCAYSP

SEQ ID NO: 1739 - protein, 35 aa, Artificial Sequence
  ILB916
PLWEQTKWQYGQAGQGSFNEDCMWDPLLMDCAYSP

SEQ ID NO: 1740 - protein, 43 aa, Artificial Sequence
  ILB790
FNEDCMWDPLLMDCAYSPGQGSATGGSAAGGGSMCLTYEEICS

SEQ ID NO: 1741 - protein, 15 aa, Artificial Sequence
  ILB754
ISMPCHSWEHCLSLL

SEQ ID NO: 1742 - protein, 16 aa, Artificial Sequence
  ILB753
GWGRVCDADYCCWVVC

SEQ ID NO: 1743 - protein, 20 aa, Artificial Sequence
  ILB909
EYDWCMWEVKMFEEACWSLS

SEQ ID NO: 1744 - protein, 17 aa, Artificial Sequence
  ILB913
VLSECFEAYRVVCQALT

SEQ ID NO: 1745 - protein, 15 aa, Artificial Sequence
  ILB911
MGIRCQTWDHCLSIL

SEQ ID NO: 1746 - protein, 15 aa, Artificial Sequence
  ILB912
QRYPCTTWEDCLVVL

SEQ ID NO: 1747 - protein, 11 aa, Artificial Sequence
  IL6R binding MRD
GDWEWVWDWCF

SEQ ID NO: 1748 - protein, 10 aa, Artificial Sequence
  IL6R binding MRD
PCQWVIYHCF

SEQ ID NO: 1749 - protein, 10 aa, Artificial Sequence
  IL6R binding MRD
WEIEWSWYWD

SEQ ID NO: 1750 - protein, 10 aa, Artificial Sequence
  IL6R binding MRD
FYMEFIIWSP

SEQ ID NO: 1751 - protein, 10 aa, Artificial Sequence
  IL6R binding MRD
WYWMLEWEWD

SEQ ID NO: 1752 - protein, 11 aa, Artificial Sequence
  IL6R binding MRD
PCEEAFAAYLE

SEQ ID NO: 1753 - protein, 12 aa, Artificial Sequence
  IL6R binding MRD
QCFAWEFVWHCD

SEQ ID NO: 1754 - protein, 10 aa, Artificial Sequence
  IL6R binding MRD
YTWDLYIYQA

SEQ ID NO: 1755 - protein, 34 aa, Artificial Sequence
  IL6R binding MRD
MYTEWQMWWIGQAGQGGGSGGGGSFYDQWEVELH

SEQ ID NO: 1756 - protein, 34 aa, Artificial Sequence
  IL6R binding MRD
AEFDWMQYGYGQAGQGGGSGGGGSYEFNWKYQEW

SEQ ID NO: 1757 - protein, 10 aa, Artificial Sequence
  IL6R binding MRD
YMQWKVEWWG

SEQ ID NO: 1758 - protein, 10 aa, Artificial Sequence
  IL6R binding MRD
WEITWDWEYY

SEQ ID NO: 1759 - protein, 12 aa, Artificial Sequence
  IL6R binding MRD
WCLITPWEVQCY

SEQ ID NO: 1760 - protein, 10 aa, Artificial Sequence
  IL6R binding MRD
TTMVFQASLG

SEQ ID NO: 1761 - protein, 11 aa, Artificial Sequence
  IL6R binding MRD
LCFCYEYEWVH

SEQ ID NO: 1762 - protein, 10 aa, Artificial Sequence
  IL6R binding MRD
HWEFYYEFGI

SEQ ID NO: 1763 - protein, 11 aa, Artificial Sequence
  IL6R binding MRD
LCYWEVWFTWE

SEQ ID NO: 1764 - protein, 12 aa, Artificial Sequence
  IL6R binding MRD
PCYLVMMEWECM

SEQ ID NO: 1765 - protein, 10 aa, Artificial Sequence
  IL6R binding MRD
GCDFYMNLCK

SEQ ID NO: 1766 - protein, 10 aa, Artificial Sequence
  IL6R binding MRD
WQEQWWYKQH

SEQ ID NO: 1767 - protein, 17 aa, Artificial Sequence
  IL6R binding MRD
SELSCYWEMKWECSWVT

SEQ ID NO: 1768 - protein, 17 aa, Artificial Sequence
  IL6R binding MRD
FCWSCEVFQMEICDELG

SEQ ID NO: 1769 - protein, 19 aa, Artificial Sequence
  IL6R binding MRD
HALHCANEERIFVQCLESS

SEQ ID NO: 1770 - protein, 19 aa, Artificial Sequence
  IL6R binding MRD
VYLECNVYEWPEAWCVVMP

SEQ ID NO: 1771 - protein, 20 aa, Artificial Sequence
  IL6R binding MRD
TQHLCAWDVRSQADMCIYWT

SEQ ID NO: 1772 - protein, 20 aa, Artificial Sequence
  IL6R binding MRD
QVYVCYVLAEQHEAICTSWA

SEQ ID NO: 1773 - protein, 20 aa, Artificial Sequence
  IL6R binding MRD
LTWVCTVMQHMNHMECLLDL

SEQ ID NO: 1774 - protein, 15 aa, Artificial Sequence
  IL6R binding MRD
MLLHCPAMWKCQSDL

SEQ ID NO: 1775 - protein, 19 aa, Artificial Sequence
  IL6R binding MRD
LTWDCYQVFEEWYDCTMSH

SEQ ID NO: 1776 - protein, 19 aa, Artificial Sequence
  IL6R binding MRD
VWGGCWYHFTIQHWCPTLS

SEQ ID NO: 1777 - protein, 19 aa, Artificial Sequence
  IL6R binding MRD
MTILCYEQREDMWDCWNVF

SEQ ID NO: 1778 - protein, 20 aa, Artificial Sequence
  IL6R binding MRD
LDCACHFEEHVRTIFCSIGH

SEQ ID NO: 1779 - protein, 19 aa, Artificial Sequence
  IL6R binding MRD
WLVDCWVVEDMNMICRLYE

SEQ ID NO: 1780 - protein, 19 aa, Artificial Sequence
  IL6R binding MRD
LDFLCYENIHNNFDCFRVM

SEQ ID NO: 1781 - protein, 18 aa, Artificial Sequence
  IL6R binding MRD
VASHCIQMPHWLLCQTLI

SEQ ID NO: 1782 - protein, 19 aa, Artificial Sequence
  IL6R binding MRD
WTVWCEWENEYGGWCDVSL

SEQ ID NO: 1783 - protein, 19 aa, Artificial Sequence
  IL6R binding MRD
LQCKCDEPYPSYYTCRVYF

SEQ ID NO: 1784 - protein, 21 aa, Artificial Sequence
  IL6R binding MRD
GPFMCMMDLHRDELLHCWASD

SEQ ID NO: 1785 - protein, 20 aa, Artificial Sequence
  IL6R binding MRD
VAVDCFWVTPYEPWYCTVMS

SEQ ID NO: 1786 - protein, 19 aa, Artificial Sequence
  IL6R binding MRD
MTDRCYTYEWQYTVCYGRN

SEQ ID NO: 1787 - protein, 52 aa, Artificial Sequence
  IL6R binding MRD
RDWRCYLMAHWVHVCGPFIGQAGQGGPGWAGGSDMDLCQDWVYESKYCVPLA

SEQ ID NO: 1788 - protein, 19 aa, Artificial Sequence
  IL6R binding MRD
SRYVICDLDMVFRECHGAF

SEQ ID NO: 1789 - protein, 19 aa, Artificial Sequence
  IL6R binding MRD
SALVLCELEMVFRECHGVL

SEQ ID NO: 1790 - protein, 19 aa, Artificial Sequence
  IL6R binding MRD
SEFILCDLAMVFAECHGAA

SEQ ID NO: 1791 - protein, 19 aa, Artificial Sequence
  IL6R binding MRD
SELLLCAFDMVISECHGTT

SEQ ID NO: 1792 - protein, 18 aa, Artificial Sequence
  IL6R binding MRD
DSFGCTWEVWGRECHPQL

SEQ ID NO: 1793 - protein, 19 aa, Artificial Sequence
  IL6R binding MRD
SEFIFCDLEMVFRECHGTT

SEQ ID NO: 1794 - protein, 19 aa, Artificial Sequence
  IL6R binding MRD
SEFVYCMLDMVFRECHGTA

SEQ ID NO: 1795 - protein, 19 aa, Artificial Sequence
  IL6R binding MRD
SELILCALEMVFNECHGAV

SEQ ID NO: 1796 - protein, 19 aa, Artificial Sequence
  IL6R binding MRD
SDLVLCEWDMVVRECHGVF

SEQ ID NO: 1797 - protein, 19 aa, Artificial Sequence
  IL6R binding MRD
SDLIWCELDMVFRECHGAA

SEQ ID NO: 1798 - protein, 19 aa, Artificial Sequence
  IL6R binding MRD
SSFVFCDLEMVFRECHGVF

SEQ ID NO: 1799 - protein, 19 aa, Artificial Sequence
  IL6R binding MRD
SDLILCNLEMVFKECHGVI

SEQ ID NO: 1800 - protein, 19 aa, Artificial Sequence
  IL6R binding MRD
SSLILCDLEMVFKECHGVL

SEQ ID NO: 1801 - protein, 19 aa, Artificial Sequence
  IL6R binding MRD
SEIVLCEWAMVLAECHGAA

SEQ ID NO: 1802 - protein, 13 aa, Artificial Sequence
  IL6R binding MRD
SRCDRVLGTHINL

SEQ ID NO: 1803 - protein, 17 aa, Artificial Sequence
  IL6R binding MRD
SHEEWTCFPYLCTFWAE

SEQ ID NO: 1804 - protein, 17 aa, Artificial Sequence
  IL6R binding MRD
SEEEWTCFPYLCSIWLE

SEQ ID NO: 1805 - protein, 17 aa, Artificial Sequence
  IL6R binding MRD
SQEEWTCFPYLCSYWLE

SEQ ID NO: 1806 - protein, 17 aa, Artificial Sequence
  IL6R binding MRD
SQEEWTCFPYLCSFWSE

SEQ ID NO: 1807 - protein, 17 aa, Artificial Sequence
  IL6R binding MRD
SHEEWTCFPYLCKYWLH

SEQ ID NO: 1808 - protein, 17 aa, Artificial Sequence
  IL6R binding MRD
SHEDWTCFPYLCKVLLH

SEQ ID NO: 1809 - protein, 17 aa, Artificial Sequence
  IL6R binding MRD
SHEEWTCFPYLCENWLH

SEQ ID NO: 1810 - protein, 17 aa, Artificial Sequence
  IL6R binding MRD
SEEEWTCFPYLCTDWVH

SEQ ID NO: 1811 - protein, 17 aa, Artificial Sequence
  IL6R binding MRD
SEEEWTCFPYLCTILLQ

SEQ ID NO: 1812 - protein, 17 aa, Artificial Sequence
  IL6R binding MRD
SDEEWTCFPYLCSVWVE

SEQ ID NO: 1813 - protein, 17 aa, Artificial Sequence
  IL6R binding MRD
SEEEWTCFPYLCSYLLH

SEQ ID NO: 1814 - protein, 17 aa, Artificial Sequence
  IL6R binding MRD
SHEDWTCFPYLCKYLLD

SEQ ID NO: 1815 - protein, 17 aa, Artificial Sequence
  IL6R binding MRD
SQEEWTCFPYLCREWVE

SEQ ID NO: 1816 - protein, 17 aa, Artificial Sequence
  IL6R binding MRD
SDEEWTCFPYLCSQWVE

SEQ ID NO: 1817 - protein, 17 aa, Artificial Sequence
  IL6R binding MRD
SEEEWTCFPYLCREWAH

SEQ ID NO: 1818 - protein, 17 aa, Artificial Sequence
  IL6R binding MRD
SEEEWTCFPYLCSYWLD

SEQ ID NO: 1819 - protein, 17 aa, Artificial Sequence
  IL6R binding MRD
SEEEWTCFPYLCSQWLE

SEQ ID NO: 1820 - protein, 17 aa, Artificial Sequence
  IL6R binding MRD
SEEEWTCFPYLCTNWLH

SEQ ID NO: 1821 - protein, 17 aa, Artificial Sequence
  IL6R binding MRD
SHEDWTCFPYLCRILVE

SEQ ID NO: 1822 - protein, 17 aa, Artificial Sequence
  IL6R binding MRD
SDEEWTCFPSLCTQLLQ

SEQ ID NO: 1823 - protein, 17 aa, Artificial Sequence
  IL6R binding MRD
SEEDWTCFPYLCRILVE

SEQ ID NO: 1824 - protein, 17 aa, Artificial Sequence
  IL6R binding MRD
SHEEWTCFPYLCGKWAE

SEQ ID NO: 1825 - protein, 17 aa, Artificial Sequence
  IL6R binding MRD
SHEDWTCFPYLCSILLQ

SEQ ID NO: 1826 - protein, 17 aa, Artificial Sequence
  IL6R binding MRD
SHEDWTCFPYLCRVLLE

SEQ ID NO: 1827 - protein, 17 aa, Artificial Sequence
  IL6R binding MRD
SDEEWTCFPYLCTFWLQ

SEQ ID NO: 1828 - protein, 17 aa, Artificial Sequence
  IL6R binding MRD
SEEEWTCFPYLCRNWLD

SEQ ID NO: 1829 - protein, 17 aa, Artificial Sequence
  IL6R binding MRD
SEEEWTCFPYLCGLWVE

SEQ ID NO: 1830 - protein, 17 aa, Artificial Sequence
  IL6R binding MRD
SEEDWTCFPYLCRILLD

SEQ ID NO: 1831 - protein, 17 aa, Artificial Sequence
  IL6R binding MRD
SHEDWTCFPYLCRILSH

SEQ ID NO: 1832 - protein, 17 aa, Artificial Sequence
  IL6R binding MRD
SEEEWTCFPYLCTNWLD

SEQ ID NO: 1833 - protein, 17 aa, Artificial Sequence
  IL6R binding MRD
SEEEWTCFPYLCSDWLE

SEQ ID NO: 1834 - protein, 17 aa, Artificial Sequence
  IL6R binding MRD
SEEEWTCFPYLCTHWLH

SEQ ID NO: 1835 - protein, 17 aa, Artificial Sequence
  IL6R binding MRD
SEEEWTCFPSLCNFWSQ

SEQ ID NO: 1836 - protein, 17 aa, Artificial Sequence
  IL6R binding MRD
SQEEWTCFPYLCTYWLQ

SEQ ID NO: 1837 - protein, 17 aa, Artificial Sequence
  IL6R binding MRD
SHEEWTCFPYLCTYWSH

SEQ ID NO: 1838 - protein, 17 aa, Artificial Sequence
  IL6R binding MRD
SDEEWTCFPYLCSIWAQ

SEQ ID NO: 1839 - protein, 17 aa, Artificial Sequence
  IL6R binding MRD
SDEEWTCFPYLCSYWVD

SEQ ID NO: 1840 - protein, 17 aa, Artificial Sequence
  IL6R binding MRD
SHEEWTCFPYLCRILLD

SEQ ID NO: 1841 - protein, 17 aa, Artificial Sequence
  IL6R binding MRD
SQEEWTCFPYLCTDWLH

SEQ ID NO: 1842 - protein, 17 aa, Artificial Sequence
  IL6R binding MRD
SEEEWTCFPYLCSFWLE

SEQ ID NO: 1843 - protein, 17 aa, Artificial Sequence
  IL6R binding MRD
SHEDWTCFPYLCTLLLQ

SEQ ID NO: 1844 - protein, 17 aa, Artificial Sequence
  IL6R binding MRD
SHEDWTCFPYLCNILLQ

SEQ ID NO: 1845 - protein, 17 aa, Artificial Sequence
  IL6R binding MRD
SEEEWTCFPYLCSHWAE

SEQ ID NO: 1846 - protein, 17 aa, Artificial Sequence
  IL6R binding MRD
SHEEWTCFPYLCKILLE

SEQ ID NO: 1847 - protein, 17 aa, Artificial Sequence
  IL6R binding MRD
SQEEWTCFPYLCSYWLQ

SEQ ID NO: 1848 - protein, 17 aa, Artificial Sequence
  IL6R binding MRD
SEEEWTCFPYLCSIWLD

SEQ ID NO: 1849 - protein, 17 aa, Artificial Sequence
  IL6R binding MRD
SHEEWTCFPTLCTDWLQ

SEQ ID NO: 1850 - protein, 17 aa, Artificial Sequence
  IL6R binding MRD
SEEEWTCFPSLCTIWLQ

SEQ ID NO: 1851 - protein, 17 aa, Artificial Sequence
  IL6R binding MRD
SHEEWTCFPYLCSDWLQ

SEQ ID NO: 1852 - protein, 17 aa, Artificial Sequence
  IL6R binding MRD
SEEEWTCFPYLCSLWVD

SEQ ID NO: 1853 - protein, 17 aa, Artificial Sequence
  IL6R binding MRD
SHEEWTCFPYLCSVWAQ

SEQ ID NO: 1854 - protein, 17 aa, Artificial Sequence
  IL6R binding MRD
SHEEWTCFPYLCSLWAQ

SEQ ID NO: 1855 - protein, 17 aa, Artificial Sequence
  IL6R binding MRD
SDEEWTCFPTLCTDWLQ

SEQ ID NO: 1856 - protein, 17 aa, Artificial Sequence
  IL6R binding MRD
SQEEWTCFPYLCSHWLD

SEQ ID NO: 1857 - protein, 17 aa, Artificial Sequence
  IL6R binding MRD
SEAEWTCFPYLCSDWLH

SEQ ID NO: 1858 - protein, 17 aa, Artificial Sequence
  IL6R binding MRD
SEEEWTCFPYLCGQWVE

SEQ ID NO: 1859 - protein, 17 aa, Artificial Sequence
  IL6R binding MRD
SDEEWTCFPSLCSFWLE

SEQ ID NO: 1860 - protein, 17 aa, Artificial Sequence
  IL6R binding MRD
SEEEWTCFPYLCTLWSQ

SEQ ID NO: 1861 - protein, 17 aa, Artificial Sequence
  IL6R binding MRD
SDEEWTCFPTLCSLWSE

SEQ ID NO: 1862 - protein, 17 aa, Artificial Sequence
  IL6R binding MRD
SDEEWTCFPSLCSFWLD

SEQ ID NO: 1863 - protein, 17 aa, Artificial Sequence
  IL6R binding MRD
SQEEWTCFPYLCTDWVQ

SEQ ID NO: 1864 - protein, 17 aa, Artificial Sequence
  IL6R binding MRD
SEEEWTCFPYLCSILVD

SEQ ID NO: 1865 - protein, 17 aa, Artificial Sequence
  IL6R binding MRD
SEEEWTCFPYLCSKLLH

SEQ ID NO: 1866 - protein, 17 aa, Artificial Sequence
  IL6R binding MRD
SEEEWTCFPYLCGKWLQ

SEQ ID NO: 1867 - protein, 17 aa, Artificial Sequence
  IL6R binding MRD
SEEEWTCFPYLCTQLLH

SEQ ID NO: 1868 - protein, 17 aa, Artificial Sequence
  IL6R binding MRD
SDEDWTCFPYLCRILLE

SEQ ID NO: 1869 - protein, 17 aa, Artificial Sequence
  IL6R binding MRD
SQEEWTCFPSLCSDWVQ

SEQ ID NO: 1870 - protein, 17 aa, Artificial Sequence
  IL6R binding MRD
SDEEWTCFPYLCSFWAQ

SEQ ID NO: 1871 - protein, 17 aa, Artificial Sequence
  IL6R binding MRD
SEEEWTCFPYLCRELLE

SEQ ID NO: 1872 - protein, 17 aa, Artificial Sequence
  IL6R binding MRD
SEEEWTCFPSLCGVWAE

SEQ ID NO: 1873 - protein, 17 aa, Artificial Sequence
  IL6R binding MRD
SHEEWTCFPYLCTVWAE

SEQ ID NO: 1874 - protein, 17 aa, Artificial Sequence
  IL6R binding MRD
SEEEWTCFPYLCTNLVE

SEQ ID NO: 1875 - protein, 17 aa, Artificial Sequence
  IL6R binding MRD
SQEEWTCFPYLCSKWVD

SEQ ID NO: 1876 - protein, 17 aa, Artificial Sequence
  IL6R binding MRD
SQEEWTCFPYLCSDWLQ

SEQ ID NO: 1877 - protein, 17 aa, Artificial Sequence
  IL6R binding MRD
SDEEWTCFPYLCSYWLQ

SEQ ID NO: 1878 - protein, 44 aa, Artificial Sequence
  IL6R binding MRD
SDEEWTCVPSLCAKLADGQAGQAAAGGSHEEWTCFAYLCGLLAD

SEQ ID NO: 1879 - protein, 17 aa, Artificial Sequence
  IL6R binding MRD
SHEEWTCFPYLCTYWLQ

SEQ ID NO: 1880 - protein, 17 aa, Artificial Sequence
  IL6R binding MRD
SEEEWTCFPYLCSEWAQ

SEQ ID NO: 1881 - protein, 17 aa, Artificial Sequence
  IL6R binding MRD
SEEEWTCFPYLCSQWLH

SEQ ID NO: 1882 - protein, 17 aa, Artificial Sequence
  IL6R binding MRD
SDEEWTCFPYLCSEWLQ

SEQ ID NO: 1883 - protein, 16 aa, Artificial Sequence
  IL6R binding MRD
SACEEAFAAYLEDSAV

SEQ ID NO: 1884 - protein, 17 aa, Artificial Sequence
  IL6R binding MRD
SDEEWTCFPYLCEYWLQ

SEQ ID NO: 1885 - protein, 17 aa, Artificial Sequence
  IL6R binding MRD
SQEEWTCFPYLCRILVD

SEQ ID NO: 1886 - protein, 17 aa, Artificial Sequence
  IL6R binding MRD
SHEEWTCFPYLCSYLLE

SEQ ID NO: 1887 - protein, 17 aa, Artificial Sequence
  IL6R binding MRD
SEEEWTCFPSLCKILLQ

SEQ ID NO: 1888 - protein, 17 aa, Artificial Sequence
  IL6R binding MRD
SEEEWTCFPYLCSKWVE

SEQ ID NO: 1889 - protein, 16 aa, Artificial Sequence
  IL6R binding MRD
SACEEAFAAYLEDGLM

SEQ ID NO: 1890 - protein, 17 aa, Artificial Sequence
  IL6R binding MRD
SEEEWTCFPSLCSNLVQ

SEQ ID NO: 1891 - protein, 17 aa, Artificial Sequence
  IL6R binding MRD
SHEEWTCFPYLCSFWAE

SEQ ID NO: 1892 - protein, 17 aa, Artificial Sequence
  IL6R binding MRD
SHEEWTCFPSLCTLWSH

SEQ ID NO: 1893 - protein, 17 aa, Artificial Sequence
  IL6R binding MRD
SEEEWTCFPYLCSKWLD

SEQ ID NO: 1894 - protein, 17 aa, Artificial Sequence
  IL6R binding MRD
SEEEWTCFPYLCTYWVD

SEQ ID NO: 1895 - protein, 17 aa, Artificial Sequence
  IL6R binding MRD
SDEEWTCFPYLCDYWLH

SEQ ID NO: 1896 - protein, 17 aa, Artificial Sequence
  IL6R binding MRD
SHEEWTCFPYLCSFWLE

SEQ ID NO: 1897 - protein, 17 aa, Artificial Sequence
  IL6R binding MRD
SDEEWTCFPYLCTDWLH

SEQ ID NO: 1898 - protein, 17 aa, Artificial Sequence
  IL6R binding MRD
SHEEWTCFPYLCNLLSH

SEQ ID NO: 1899 - protein, 17 aa, Artificial Sequence
  IL6R binding MRD
SQDEWTCFPSLCSDLSE

SEQ ID NO: 1900 - protein, 17 aa, Artificial Sequence
  IL6R binding MRD
SEEEWTCFPYLCSFWLQ

SEQ ID NO: 1901 - protein, 17 aa, Artificial Sequence
  IL6R binding MRD
SEEEWTCFPYLCSLWLE

SEQ ID NO: 1902 - protein, 17 aa, Artificial Sequence
  IL6R binding MRD
SHEEWTCFPYLCSYWLE

SEQ ID NO: 1903 - protein, 18 aa, Artificial Sequence
  IL6R binding MRD
FMVHCTWYDVTIDCVGPT

SEQ ID NO: 1904 - protein, 18 aa, Artificial Sequence
  IL6R binding MRD
SDISCSYIDGWYQCLLHL

SEQ ID NO: 1905 - protein, 18 aa, Artificial Sequence
  IL6R binding MRD
WGCLCQQQGHFMECEITW

SEQ ID NO: 1906 - protein, 18 aa, Artificial Sequence
  IL6R binding MRD
ESLLCIQHDVWVDCYIVE

SEQ ID NO: 1907 - protein, 18 aa, Artificial Sequence
  IL6R binding MRD
NSSFCYIHAIEWVCESSS

SEQ ID NO: 1908 - protein, 20 aa, Artificial Sequence
  IL6R binding MRD
DLLYCEWEMVVRECHGTIGQ

SEQ ID NO: 1909 - protein, 18 aa, Artificial Sequence
  IL6R binding MRD
QIVECWTEMDWHHCVLFF

SEQ ID NO: 1910 - protein, 18 aa, Artificial Sequence
  ILC111
DLLYCEWEMVVRECHGTI

SEQ ID NO: 1911 - protein, 18 aa, Artificial Sequence
  ILC82
EFVLCELAMVFRECHGAV

SEQ ID NO: 1912 - protein, 18 aa, Artificial Sequence
  ILC85
ELIFCDLEMVFNECHGAI

SEQ ID NO: 1913 - protein, 18 aa, Artificial Sequence
  ILC289
DYILCDLEMVFRECHGVL

SEQ ID NO: 1914 - protein, 18 aa, Artificial Sequence
  ILC92
EFILCELEMVIRECHGTT

SEQ ID NO: 1915 - protein, 11 aa, Artificial Sequence
  ILC110
PCEEAFAAYLE

SEQ ID NO: 1916 - protein, 15 aa, Artificial Sequence
  ILC134
PCEEAFAAYLEEAYN

SEQ ID NO: 1917 - protein, 15 aa, Artificial Sequence
  ILC100
ACEEAFASYLEENVM

SEQ ID NO: 1918 - protein, 12 aa, Artificial Sequence
  ILC145
DCNALFTGDLAW

SEQ ID NO: 1919 - protein, 16 aa, Artificial Sequence
  ILC51
DEEWTCFPTLCSLWSE

SEQ ID NO: 1920 - protein, 16 aa, Artificial Sequence
  ILC163
EEEWTCFPSLCTIWSQ

SEQ ID NO: 1921 - protein, 16 aa, Artificial Sequence
  ILC168
EEEWTCFPYLCSDWLQ

SEQ ID NO: 1922 - protein, 16 aa, Artificial Sequence
  ILC235
EEEWTCFPYLCSEWVH

SEQ ID NO: 1923 - protein, 16 aa, Artificial Sequence
  ILC217
QEEWTCFPYLCSYWAQ

SEQ ID NO: 1924 - protein, 15 aa, Artificial Sequence
  ILC54
GQDDCWPYYCDELEY

SEQ ID NO: 1925 - protein, 16 aa, Artificial Sequence
  ILC293
SCWTCIPEMVNCEAAH

SEQ ID NO: 1926 - protein, 18 aa, Artificial Sequence
  ILC296
YWAKCDYHEGWHHCELHP

SEQ ID NO: 1927 - protein, 18 aa, Artificial Sequence
  ILC295
VFWDCWYYGTWIECENTG

SEQ ID NO: 1928 - protein, 16 aa, Artificial Sequence
  ILC290
GDTPCQEWPYWCLPPY

SEQ ID NO: 1929 - protein, 18 aa, Artificial Sequence
  ILC291
HLISCEFHEKYVECVEVA

SEQ ID NO: 1930 - protein, 18 aa, Artificial Sequence
  ILC294
STDYCEVLEIQWVCYRPP

SEQ ID NO: 1931 - protein, 18 aa, Artificial Sequence
  ILC292
QIVECWTEMDWHHCVLFF

SEQ ID NO: 1932 - protein, 17 aa, Artificial Sequence
  IL17a binding MRD
LSLWCWHDQAEFCVESN

SEQ ID NO: 1933 - protein, 18 aa, Artificial Sequence
  IL17a binding MRD
SKYDCFWEHEWLYCAPRM

SEQ ID NO: 1934 - protein, 18 aa, Artificial Sequence
  IL17a binding MRD
FDLYCWVWPDMMECTAGT

SEQ ID NO: 1935 - protein, 18 aa, Artificial Sequence
  IL17a binding MRD
GTWDCWVEGEWVYCTPWS

SEQ ID NO: 1936 - protein, 17 aa, Artificial Sequence
  IL17a binding MRD
STEGCHQDWYDLCAFLA

SEQ ID NO: 1937 - protein, 18 aa, Artificial Sequence
  IL17a binding MRD
LSLWCWMFPEHNACLSPV

SEQ ID NO: 1938 - protein, 18 aa, Artificial Sequence
  IL17a binding MRD
ESLWCWMFPNEQTCLVQH

SEQ ID NO: 1939 - protein, 18 aa, Artificial Sequence
  IL17a binding MRD
VSYLCDEYQGLLYCMVQR

SEQ ID NO: 1940 - protein, 17 aa, Artificial Sequence
  IL17a binding MRD
LDLWCWFPNDTKCMRLT

SEQ ID NO: 1941 - protein, 18 aa, Artificial Sequence
  IL17a binding MRD
LGLWCFVYPDDQMCIRSW

SEQ ID NO: 1942 - protein, 17 aa, Artificial Sequence
  IL17a binding MRD
MGELCEFFGFHDCPMQI

SEQ ID NO: 1943 - protein, 18 aa, Artificial Sequence
  IL17a binding MRD
SETLCWDGWDIWICQDPQ

SEQ ID NO: 1944 - protein, 18 aa, Artificial Sequence
  IL17a binding MRD
DWATCWEFNELWYCIPYN

SEQ ID NO: 1945 - protein, 18 aa, Artificial Sequence
  IL17a binding MRD
IDPGCWLTPWSFQCPGYM

SEQ ID NO: 1946 - protein, 18 aa, Artificial Sequence
  IL17a binding MRD
LGLWCWMFPIDSFCYPAV

SEQ ID NO: 1947 - protein, 18 aa, Artificial Sequence
  IL17a binding MRD
LHLWCWMFPLDDACADFF

SEQ ID NO: 1948 - protein, 17 aa, Artificial Sequence
  IL17a binding MRD
LDLWCWFPNDDWCMTHL

SEQ ID NO: 1949 - protein, 20 aa, Artificial Sequence
  IL17a binding MRD
MVLDCYIIEELDEYWCDWYS

SEQ ID NO: 1950 - protein, 18 aa, Artificial Sequence
  IL17a binding MRD
LGLWCWMFPIDSFCYPAI

SEQ ID NO: 1951 - protein, 18 aa, Artificial Sequence
  IL17a binding MRD
YDVWCFFFPDEIMCNETQ

SEQ ID NO: 1952 - protein, 20 aa, Artificial Sequence
  IL17a binding MRD
VEIDCEYDWMNEYLYCAPRV

SEQ ID NO: 1953 - protein, 12 aa, Artificial Sequence
  IL17a binding MRD
KCNFNPWKAACG

SEQ ID NO: 1954 - protein, 18 aa, Artificial Sequence
  IL17a binding MRD
DWLHCEIKPPFYHCWNMT

SEQ ID NO: 1955 - protein, 16 aa, Artificial Sequence
  IL17a binding MRD
LSLWCWINDVNCSEPV

SEQ ID NO: 1956 - protein, 18 aa, Artificial Sequence
  IL17a binding MRD
LSLWCFIDETSEQCSILS

SEQ ID NO: 1957 - protein, 21 aa, Artificial Sequence
  IL17a binding MRD
MDLSCWMTDPTLEWWFCEYRP

SEQ ID NO: 1958 - protein, 18 aa, Artificial Sequence
  IL17a binding MRD
LNLWCWMFPAAAECEFDQ

SEQ ID NO: 1959 - protein, 18 aa, Artificial Sequence
  IL17a binding MRD
WCFGCVIPPFWYECMCPT

SEQ ID NO: 1960 - protein, 18 aa, Artificial Sequence
  IL17a binding MRD
LTLWCWIFPQDEICWTML

SEQ ID NO: 1961 - protein, 18 aa, Artificial Sequence
  IL17a binding MRD
IFFDCTFSDWQLDCVELD

SEQ ID NO: 1962 - protein, 18 aa, Artificial Sequence
  IL17a binding MRD
LALWCWMFPMSDECPPKH

SEQ ID NO: 1963 - protein, 16 aa, Artificial Sequence
  IL17a binding MRD
GHIGCWGPEWYCHWYG

SEQ ID NO: 1964 - protein, 18 aa, Artificial Sequence
  IL17a binding MRD
VDELCVFMFGQSDCRNLF

SEQ ID NO: 1965 - protein, 18 aa, Artificial Sequence
  IL17a binding MRD
LSLWCWAFPSDTVCLARL

SEQ ID NO: 1966 - protein, 19 aa, Artificial Sequence
  IL17a binding MRD
STWECWEVNNETYECARLL

SEQ ID NO: 1967 - protein, 18 aa, Artificial Sequence
  IL17a binding MRD
SNPWCHIAEYELWCWMGH

SEQ ID NO: 1968 - protein, 19 aa, Artificial Sequence
  IL17a binding MRD
TSWECHETGDDYFYCWHLK

SEQ ID NO: 1969 - protein, 18 aa, Artificial Sequence
  IL17a binding MRD
LDLVCWMYPTEKACWSMR

SEQ ID NO: 1970 - protein, 18 aa, Artificial Sequence
  IL17a binding MRD
LGLWCWMFPWEQVCSVRL

SEQ ID NO: 1971 - protein, 20 aa, Artificial Sequence
  IL17a binding MRD
TWYLCWESQWWDVYYCEEEG

SEQ ID NO: 1972 - protein, 18 aa, Artificial Sequence
  IL17a binding MRD
MSLWCWMFPWDNMCFKFS

SEQ ID NO: 1973 - protein, 19 aa, Artificial Sequence
  IL17a binding MRD
IRDDCQENWQSELVCFLLG

SEQ ID NO: 1974 - protein, 18 aa, Artificial Sequence
  IL17a binding MRD
LGLWCWMFPMDPDCHRGY

SEQ ID NO: 1975 - protein, 20 aa, Artificial Sequence
  IL17a binding MRD
LAYECWVLEDLEYVICEQGM

SEQ ID NO: 1976 - protein, 19 aa, Artificial Sequence
  IL17a binding MRD
LFFICYETPEEYMYCLPKG

SEQ ID NO: 1977 - protein, 18 aa, Artificial Sequence
  IL17a binding MRD
QSPWCFMFPQEEHCNHYN

SEQ ID NO: 1978 - protein, 18 aa, Artificial Sequence
  IL17a binding MRD
LSLWCWIFPTEETCKHGL

SEQ ID NO: 1979 - protein, 17 aa, Artificial Sequence
  IL17a binding MRD
HSAWCWFPEDNICLDRR

SEQ ID NO: 1980 - protein, 19 aa, Artificial Sequence
  IL17a binding MRD
LTMWCEEMIKDEWWCVPAI

SEQ ID NO: 1981 - protein, 17 aa, Artificial Sequence
  IL17a binding MRD
NALWCWFPEASECGLME

SEQ ID NO: 1982 - protein, 18 aa, Artificial Sequence
  IL17a binding MRD
YTYYCVETEYNMVCELDY

SEQ ID NO: 1983 - protein, 17 aa, Artificial Sequence
  IL17a binding MRD
IGWQCEYLPWDECQWQF

SEQ ID NO: 1984 - protein, 18 aa, Artificial Sequence
  IL17a binding MRD
DDLFCWMFPSAYVCLPPV

SEQ ID NO: 1985 - protein, 17 aa, Artificial Sequence
  IL17a binding MRD
QDELCNFIFNDHCASAF

SEQ ID NO: 1986 - protein, 17 aa, Artificial Sequence
  IL17a binding MRD
LQELCHYLGFEECVGQQ

SEQ ID NO: 1987 - protein, 18 aa, Artificial Sequence
  IL17a binding MRD
ASLWCWMYPNDISCFMES

SEQ ID NO: 1988 - protein, 17 aa, Artificial Sequence
  IL17a binding MRD
TADLCMFLWHQDCGRIF

SEQ ID NO: 1989 - protein, 18 aa, Artificial Sequence
  IL17a binding MRD
LSLWCWLHDQAEFCVESN

SEQ ID NO: 1990 - protein, 20 aa, Artificial Sequence
  IL17a binding MRD
WPLECYTDEELYDIWCLMDL

SEQ ID NO: 1991 - protein, 17 aa, Artificial Sequence
  ILA72
LSLWCWLINDVNCSEPV

SEQ ID NO: 1992 - protein, 18 aa, Artificial Sequence
  ILA20
NPLWCWMFPADDPCVHPG

SEQ ID NO: 1993 - protein, 18 aa, Artificial Sequence
  TNFSF15 (TL1A) binding MRD
LLGDCFAGFDNIWCEFLD

SEQ ID NO: 1994 - protein, 12 aa, Artificial Sequence
  TNFSF15 (TL1A) binding MRD
KCNFNPWKAACG

SEQ ID NO: 1995 - protein, 16 aa, Artificial Sequence
  TNFSF15 (TL1A) binding MRD
QTFWCYDDWHECSGKP

SEQ ID NO: 1996 - protein, 18 aa, Artificial Sequence
  TNFSF15 (TL1A) binding MRD
LNHSCWWWDEWEECPHNV

SEQ ID NO: 1997 - protein, 16 aa, Artificial Sequence
  TNFSF15 (TL1A) binding MRD
KVEYCYDDWHQCKQVQ

SEQ ID NO: 1998 - protein, 18 aa, Artificial Sequence
  TNFSF15 (TL1A) binding MRD
DDSMCAWWDEWHECEHHS

SEQ ID NO: 1999 - protein, 12 aa, Artificial Sequence
  TNFSF15 (TL1A) binding MRD
EYMYCYDDWYDC

SEQ ID NO: 2000 - protein, 36 aa, Artificial Sequence
  TNFSF15 (TL1A) binding MRD
DNTDCYYQGYWVYCTDLNDNTDCYYQGYWVYCTDLN

SEQ ID NO: 2001 - protein, 40 aa, Artificial Sequence
  TNFSF15 (TL1A) binding MRD
RSDVCWDMAAQHLFYCGEWIRSDVCWDMAAQHLFYCGEWI

SEQ ID NO: 2002 - protein, 40 aa, Artificial Sequence
  TNFSF15 (TL1A) binding MRD
RYDVCWDQKLQELYYCSYYHRYDVCWDQKLQELYYCSYYH

SEQ ID NO: 2003 - protein, 40 aa, Artificial Sequence
  TNFSF15 (TL1A) binding MRD
LSSVCWNNSAEKLEYCGPLELSSVCWNNSAEKLEYCGPLE

SEQ ID NO: 2004 - protein, 36 aa, Artificial Sequence
  TNFSF15 (TL1A) binding MRD
HITICDYQEYFYMCTILYHITICDYQEYFYMCTILY

SEQ ID NO: 2005 - protein, 40 aa, Artificial Sequence
  TNFSF15 (TL1A) binding MRD
DMAGCHWDPVYINFDCRASMDMAGCHWDPVYINFDCRASM

SEQ ID NO: 2006 - protein, 36 aa, Artificial Sequence
  TNFSF15 (TL1A) binding MRD
KFNECFVGYDYIWCNSSVKFNECFVGYDYIWCNSSV

SEQ ID NO: 2007 - protein, 40 aa, Artificial Sequence
  TNFSF15 (TL1A) binding MRD
GEDTCHWVHFIDDWYCLAPMGEDTCHWVHFIDDWYCLAPM

SEQ ID NO: 2008 - protein, 40 aa, Artificial Sequence
  TNFSF15 (TL1A) binding MRD
EVTICQYTEDFTYYYCTRPNEVTICQYTEDFTYYYCTRPN

SEQ ID NO: 2009 - protein, 36 aa, Artificial Sequence
  TNFSF15 (TL1A) binding MRD
EVCWDSESESIQWCDMEWEVCWDSESESIQWCDMEW

SEQ ID NO: 2010 - protein, 44 aa, Artificial Sequence
  TNFSF15 (TL1A) binding MRD
PFVVCYTQWQGEREFHNCWKLQPFVVCYTQWQGEREFHNCWKLQ

SEQ ID NO: 2011 - protein, 32 aa, Artificial Sequence
  TNFSF15 (TL1A) binding MRD
QTVRVCFYDRCQDVKFQTVRVCFYDRCQDVKF

SEQ ID NO: 2012 - protein, 40 aa, Artificial Sequence
  TNFSF15 (TL1A) binding MRD
QKAICWNTEHITYYYCSRPNQKAICWNTEHITYYYCSRPN

SEQ ID NO: 2013 - protein, 36 aa, Artificial Sequence
  TNFSF15 (TL1A) binding MRD
SSWDCMGGPIVWVCPEGRSSWDCMGGPIVWVCPEGR

SEQ ID NO: 2014 - protein, 32 aa, Artificial Sequence
  TNFSF15 (TL1A) binding MRD
RVEECSYEFRQCLANYRVEECSYEFRQCLANY

SEQ ID NO: 2015 - protein, 40 aa, Artificial Sequence
  TNFSF15 (TL1A) binding MRD
DYDVCWDVLADRLYYCDEPIDYDVCWDVLADRLYYCDEPI

SEQ ID NO: 2016 - protein, 36 aa, Artificial Sequence
  TNFSF15 (TL1A) binding MRD
DSFGCTWEVWGRECHPQLDSFGCTWEVWGRECHPQL

SEQ ID NO: 2017 - protein, 40 aa, Artificial Sequence
  TNFSF15 (TL1A) binding MRD
DYDVCWDLEVDRLYYCDDPLDYDVCWDLEVDRLYYCDDPL

SEQ ID NO: 2018 - protein, 40 aa, Artificial Sequence
  TNFSF15 (TL1A) binding MRD
DYDVCWDVQLDRLYYCDVPMDYDVCWDVQLDRLYYCDVPM

SEQ ID NO: 2019 - protein, 40 aa, Artificial Sequence
  TNFSF15 (TL1A) binding MRD
DYDVCWDIHADRLYYCNAPFDYDVCWDIHADRLYYCNAPF

SEQ ID NO: 2020 - protein, 40 aa, Artificial Sequence
  TNFSF15 (TL1A) binding MRD
DIDVCWDIAADRLFYCHAPMDIDVCWDIAADRLFYCHAPM

SEQ ID NO: 2021 - protein, 40 aa, Artificial Sequence
  TNFSF15 (TL1A) binding MRD
DHDVCWDIDIDRLYYCEGPWDHDVCWDIDIDRLYYCEGPW

SEQ ID NO: 2022 - protein, 40 aa, Artificial Sequence
  TNFSF15 (TL1A) binding MRD
MYDVCWDLQVDKLYFCGDDLMYDVCWDLQVDKLYFCGDDL

SEQ ID NO: 2023 - protein, 40 aa, Artificial Sequence
  TNFSF15 (TL1A) binding MRD
DWDVCWDVEVDRLFYCEAPTDWDVCWDVEVDRLFYCEAPT

SEQ ID NO: 2024 - protein, 40 aa, Artificial Sequence
  TNFSF15 (TL1A) binding MRD
DFDVCWDLDLDRLVYCDAPMDFDVCWDLDLDRLVYCDAPM

SEQ ID NO: 2025 - protein, 40 aa, Artificial Sequence
  TNFSF15 (TL1A) binding MRD
DYDVCWDVHLDRLYYCNSPIDYDVCWDVHLDRLYYCNSPI

SEQ ID NO: 2026 - protein, 40 aa, Artificial Sequence
  TNFSF15 (TL1A) binding MRD
DYDVCWDIDEDRLYYCDAFLDYDVCWDIDEDRLYYCDAFL

SEQ ID NO: 2027 - protein, 40 aa, Artificial Sequence
  TNFSF15 (TL1A) binding MRD
DYDVCWDLLVDRLYYCDGPTDYDVCWDLLVDRLYYCDGPT

SEQ ID NO: 2028 - protein, 40 aa, Artificial Sequence
  TNFSF15 (TL1A) binding MRD
DYDVCWDIYDDRLYYCDTPVDYDVCWDIYDDRLYYCDTPV

SEQ ID NO: 2029 - protein, 40 aa, Artificial Sequence
  TNFSF15 (TL1A) binding MRD
ALDVCWDIEEDRLYYCDAPLALDVCWDIEEDRLYYCDAPL

SEQ ID NO: 2030 - protein, 40 aa, Artificial Sequence
  TNFSF15 (TL1A) binding MRD
DYDVCWDVYHDRLFYCEDHLDYDVCWDVYHDRLFYCEDHL

SEQ ID NO: 2031 - protein, 40 aa, Artificial Sequence
  TNFSF15 (TL1A) binding MRD
DYDVCWDFEVDRLYYCDGPGDYDVCWDFEVDRLYYCDGPG

SEQ ID NO: 2032 - protein, 40 aa, Artificial Sequence
  TNFSF15 (TL1A) binding MRD
EYDVCWDIDVDRLYYCASPMEYDVCWDIDVDRLYYCASPM

SEQ ID NO: 2033 - protein, 40 aa, Artificial Sequence
  TNFSF15 (TL1A) binding MRD
DYDVCWDIELDRLYYCDASIDYDVCWDIELDRLYYCDASI

SEQ ID NO: 2034 - protein, 40 aa, Artificial Sequence
  TNFSF15 (TL1A) binding MRD
DYDVCWDVELDRLYYCEAPLDYDVCWDVELDRLYYCEAPL

SEQ ID NO: 2035 - protein, 40 aa, Artificial Sequence
  TNFSF15 (TL1A) binding MRD
YYDVCWDLDLDILYYCDAPGYYDVCWDLDLDILYYCDAPG

SEQ ID NO: 2036 - protein, 40 aa, Artificial Sequence
  TNFSF15 (TL1A) binding MRD
DYEVCWDLQMDRLYYCEASIDYEVCWDLQMDRLYYCEASI

SEQ ID NO: 2037 - protein, 40 aa, Artificial Sequence
  TNFSF15 (TL1A) binding MRD
IFDVCWDVDEDRLYYCQAETIFDVCWDVDEDRLYYCQAET

SEQ ID NO: 2038 - protein, 40 aa, Artificial Sequence
  TNFSF15 (TL1A) binding MRD
YTDVCWDIDVDRLYYCDADVYTDVCWDIDVDRLYYCDADV

SEQ ID NO: 2039 - protein, 40 aa, Artificial Sequence
  TNFSF15 (TL1A) binding MRD
EDAVCWDPAHEKLVWCNRFEEDAVCWDPAHEKLVWCNRFE

SEQ ID NO: 2040 - protein, 40 aa, Artificial Sequence
  TNFSF15 (TL1A) binding MRD
DYDVCWDVNADRLFYCDDAIDYDVCWDVNADRLFYCDDAI

SEQ ID NO: 2041 - protein, 40 aa, Artificial Sequence
  TNFSF15 (TL1A) binding MRD
DYDVCWDVDEDRLYYCNVPIDYDVCWDVDEDRLYYCNVPI

SEQ ID NO: 2042 - protein, 20 aa, Artificial Sequence
  TNFSF15 (TL1A) binding MRD
DYDVCWDLDFDRLYYCHPAE

SEQ ID NO: 2043 - protein, 20 aa, Artificial Sequence
  TNFSF15 (TL1A) binding MRD
RWDVCWDYHADKLFFCNEDL

SEQ ID NO: 2044 - protein, 20 aa, Artificial Sequence
  TNFSF15 (TL1A) binding MRD
DYDVCWDVDLDRLYYCEAPM

SEQ ID NO: 2045 - protein, 20 aa, Artificial Sequence
  TNFSF15 (TL1A) binding MRD
EYEVCWDVHVHRLVFCNVPV

SEQ ID NO: 2046 - protein, 20 aa, Artificial Sequence
  TNFSF15 (TL1A) binding MRD
KTDVCWDLLLDKLYFCDIDT

SEQ ID NO: 2047 - protein, 20 aa, Artificial Sequence
  TNFSF15 (TL1A) binding MRD
RDDVCWDYNTDKLYFCGSNI

SEQ ID NO: 2048 - protein, 20 aa, Artificial Sequence
  TNFSF15 (TL1A) binding MRD
DYDVCWDYDVDRLYYCDFPV

SEQ ID NO: 2049 - protein, 20 aa, Artificial Sequence
  TNFSF15 (TL1A) binding MRD
NYDVCWDVSEDRLYYCDAPR

SEQ ID NO: 2050 - protein, 20 aa, Artificial Sequence
  TNFSF15 (TL1A) binding MRD
DWDVCWDLLEDRLYYCEDPM

SEQ ID NO: 2051 - protein, 20 aa, Artificial Sequence
  TNFSF15 (TL1A) binding MRD
EYDHCWDVSRAKLELCWEHN

SEQ ID NO: 2052 - protein, 20 aa, Artificial Sequence
  TNFSF15 (TL1A) binding MRD
EYAVCWDEAQQKLVWCKDLN

SEQ ID NO: 2053 - protein, 20 aa, Artificial Sequence
  TNFSF15 (TL1A) binding MRD
DYDVCWDIYEDRLFYCEMHV

SEQ ID NO: 2054 - protein, 20 aa, Artificial Sequence
  TNFSF15 (TL1A) binding MRD
KLDVCWDLDVDRLYFCDAPM

SEQ ID NO: 2055 - protein, 20 aa, Artificial Sequence
  TNFSF15 (TL1A) binding MRD
DYDVCWDVLVDRLYYCDVPM

SEQ ID NO: 2056 - protein, 20 aa, Artificial Sequence
  TNFSF15 (TL1A) binding MRD
DYDVCWDLHLDRLYYCHAYC

SEQ ID NO: 2057 - protein, 20 aa, Artificial Sequence
  TNFSF15 (TL1A) binding MRD
DYDVCWDIDLDRLYYCDAGS

SEQ ID NO: 2058 - protein, 20 aa, Artificial Sequence
  TNFSF15 (TL1A) binding MRD
DYDVCWDIDADRLYYCHAAM

SEQ ID NO: 2059 - protein, 20 aa, Artificial Sequence
  TNFSF15 (TL1A) binding MRD
KYDVCWDDYLDILYYCNGPL

SEQ ID NO: 2060 - protein, 20 aa, Artificial Sequence
  TNFSF15 (TL1A) binding MRD
HLDVCWDIDLDHLYYCDLGM

SEQ ID NO: 2061 - protein, 20 aa, Artificial Sequence
  TNFSF15 (TL1A) binding MRD
MYDVCWDLEVDRLYYCEAPM

SEQ ID NO: 2062 - protein, 20 aa, Artificial Sequence
  TNFSF15 (TL1A) binding MRD
EYDVCWDIDSDRLYLCVGLM

SEQ ID NO: 2063 - protein, 20 aa, Artificial Sequence
  TNFSF15 (TL1A) binding MRD
DYDVCWDVHADRLYYCKEDI

SEQ ID NO: 2064 - protein, 20 aa, Artificial Sequence
  TNFSF15 (TL1A) binding MRD
DYDVCWDLNLDRLYYCDSPM

SEQ ID NO: 2065 - protein, 20 aa, Artificial Sequence
  TNFSF15 (TL1A) binding MRD
EYDVCWDVQNDRLYYCDAPE

SEQ ID NO: 2066 - protein, 20 aa, Artificial Sequence
  TNFSF15 (TL1A) binding MRD
DYDVCWDYDVDRLYYCNFQS

SEQ ID NO: 2067 - protein, 20 aa, Artificial Sequence
  TNFSF15 (TL1A) binding MRD
DYDVCWDYKIDHLYYCDGPV

SEQ ID NO: 2068 - protein, 20 aa, Artificial Sequence
  TNFSF15 (TL1A) binding MRD
GYDVCWDYEEDRLFYCESPL

SEQ ID NO: 2069 - protein, 20 aa, Artificial Sequence
  TNFSF15 (TL1A) binding MRD
DYDVCWDLDNDRLFYCDSAM

SEQ ID NO: 2070 - protein, 20 aa, Artificial Sequence
  TNFSF15 (TL1A) binding MRD
KFHVCWDSHQDKLVYCSLKV

SEQ ID NO: 2071 - protein, 20 aa, Artificial Sequence
  TNFSF15 (TL1A) binding MRD
LEFVCWDDDRGKLVFCAGHM

SEQ ID NO: 2072 - protein, 20 aa, Artificial Sequence
  TNFSF15 (TL1A) binding MRD
GHEVCWDMHNEKLVFCRTHI

SEQ ID NO: 2073 - protein, 20 aa, Artificial Sequence
  TNFSF15 (TL1A) binding MRD
NKAVCWNYHQEKLEFCNSTM

SEQ ID NO: 2074 - protein, 20 aa, Artificial Sequence
  TNFSF15 (TL1A) binding MRD
TYAVCWDFNAHKLVFCDDMM

SEQ ID NO: 2075 - protein, 20 aa, Artificial Sequence
  TNFSF15 (TL1A) binding MRD
EYALCWVEAQEKLVWCKDLI

SEQ ID NO: 2076 - protein, 20 aa, Artificial Sequence
  TNFSF15 (TL1A) binding MRD
DYAVCWVEDQGKLVWCNGVN

SEQ ID NO: 2077 - protein, 20 aa, Artificial Sequence
  TNFSF15 (TL1A) binding MRD
DYAVCWDEAQEKLVWCNGLS

SEQ ID NO: 2078 - protein, 20 aa, Artificial Sequence
  TNFSF15 (TL1A) binding MRD
EYAVCWVHSQEKLDWCTGSK

SEQ ID NO: 2079 - protein, 20 aa, Artificial Sequence
  TNFSF15 (TL1A) binding MRD
EYAVCWNEARGKLEYCTALK

SEQ ID NO: 2080 - protein, 20 aa, Artificial Sequence
  TNFSF15 (TL1A) binding MRD
DYAVCWDEHKQKLEFCRTFI

SEQ ID NO: 2081 - protein, 20 aa, Artificial Sequence
  TNFSF15 (TL1A) binding MRD
EYTVCWDASNEKLYFCHYPL

SEQ ID NO: 2082 - protein, 20 aa, Artificial Sequence
  TNFSF15 (TL1A) binding MRD
SLDVCWDHHLDKLTFCNLNM

SEQ ID NO: 2083 - protein, 20 aa, Artificial Sequence
  TNFSF15 (TL1A) binding MRD
QLDVCWDDHYQKLYFCYARI

SEQ ID NO: 2084 - protein, 20 aa, Artificial Sequence
  TNFSF15 (TL1A) binding MRD
SYDVCWDSRLTKLVYCNASN

SEQ ID NO: 2085 - protein, 20 aa, Artificial Sequence
  TNFSF15 (TL1A) binding MRD
QYAVCWDEALEKLLWCKELH

SEQ ID NO: 2086 - protein, 20 aa, Artificial Sequence
  TNFSF15 (TL1A) binding MRD
DYAVCWSEAQDKLEWCIGHN

SEQ ID NO: 2087 - protein, 20 aa, Artificial Sequence
  TNFSF15 (TL1A) binding MRD
EYAVCWVEEHEKLLWCEGLN

SEQ ID NO: 2088 - protein, 20 aa, Artificial Sequence
  TNFSF15 (TL1A) binding MRD
EYSVCWVVDQEKLVWCRSLH

SEQ ID NO: 2089 - protein, 20 aa, Artificial Sequence
  TNFSF15 (TL1A) binding MRD
EYAVCWSEAQGKLEWCQGSN

SEQ ID NO: 2090 - protein, 20 aa, Artificial Sequence
  TNFSF15 (TL1A) binding MRD
DYAVCWDVGLEKLVWCKGSL

SEQ ID NO: 2091 - protein, 20 aa, Artificial Sequence
  TNFSF15 (TL1A) binding MRD
PPAVCWDNNSSKLVFCHSFI

SEQ ID NO: 2092 - protein, 20 aa, Artificial Sequence
  TNFSF15 (TL1A) binding MRD
SSNVCWDDVLETLRFCHTHM

SEQ ID NO: 2093 - protein, 20 aa, Artificial Sequence
  TNFSF15 (TL1A) binding MRD
LDQVCWDLYANKLIFCADVI

SEQ ID NO: 2094 - protein, 20 aa, Artificial Sequence
  TNFSF15 (TL1A) binding MRD
NLDVCWDNNRGKLMFCRNHD

SEQ ID NO: 2095 - protein, 20 aa, Artificial Sequence
  TNFSF15 (TL1A) binding MRD
SYAVCWNALEEKLVFCTDEI

SEQ ID NO: 2096 - protein, 20 aa, Artificial Sequence
  TNFSF15 (TL1A) binding MRD
PNEVCWDSHKEKLVFCTHQM

SEQ ID NO: 2097 - protein, 20 aa, Artificial Sequence
  TNFSF15 (TL1A) binding MRD
EYALCWLEAQEKLDWCTELN

SEQ ID NO: 2098 - protein, 20 aa, Artificial Sequence
  TNFSF15 (TL1A) binding MRD
ENAVCWDESQEKLVWCNGIR

SEQ ID NO: 2099 - protein, 20 aa, Artificial Sequence
  TNFSF15 (TL1A) binding MRD
ESDVCWNENVEQLEFCNGRF

SEQ ID NO: 2100 - protein, 20 aa, Artificial Sequence
  TNFSF15 (TL1A) binding MRD
EYAVCWDEAPEKLIWCEGLN

SEQ ID NO: 2101 - protein, 20 aa, Artificial Sequence
  TNFSF15 (TL1A) binding MRD
RWAVCWDTDRQKLLFCGPML

SEQ ID NO: 2102 - protein, 20 aa, Artificial Sequence
  TNFSF15 (TL1A) binding MRD
LDLVCWDENSQKLLFCTKPG

SEQ ID NO: 2103 - protein, 20 aa, Artificial Sequence
  TNFSF15 (TL1A) binding MRD
QSSVCWDYNSQKLRFCDMSL

SEQ ID NO: 2104 - protein, 20 aa, Artificial Sequence
  TNFSF15 (TL1A) binding MRD
RLDVCWDEHASKLVFCRSYM

SEQ ID NO: 2105 - protein, 20 aa, Artificial Sequence
  TNFSF15 (TL1A) binding MRD
ISAVCWDTQLQKLVFCNASM

SEQ ID NO: 2106 - protein, 20 aa, Artificial Sequence
  TNFSF15 (TL1A) binding MRD
LDTVCWDIHSGRLVFCASLL

SEQ ID NO: 2107 - protein, 20 aa, Artificial Sequence
  TNFSF15 (TL1A) binding MRD
EYALCWDDPLEKLQWCKDIS

SEQ ID NO: 2108 - protein, 20 aa, Artificial Sequence
  TNFSF15 (TL1A) binding MRD
EYALCWNEVQEKLVWCKELN

SEQ ID NO: 2109 - protein, 20 aa, Artificial Sequence
  TNFSF15 (TL1A) binding MRD
EYAVCWDEVQDKLVWCNGVN

SEQ ID NO: 2110 - protein, 20 aa, Artificial Sequence
  TNFSF15 (TL1A) binding MRD
EYAVCWDEVQERLEWCTRPN

SEQ ID NO: 2111 - protein, 20 aa, Artificial Sequence
  TNFSF15 (TL1A) binding MRD
EFAVCWDDGQEKLVWCNRLH

SEQ ID NO: 2112 - protein, 20 aa, Artificial Sequence
  TNFSF15 (TL1A) binding MRD
EYALCWNEVHEQLEFCIGRN

SEQ ID NO: 2113 - protein, 20 aa, Artificial Sequence
  TNFSF15 (TL1A) binding MRD
RSEVCWDTHLFKLVYCQDWF

SEQ ID NO: 2114 - protein, 20 aa, Artificial Sequence
  TNFSF15 (TL1A) binding MRD
QSYVCWDEHQSRLRFCSETI

SEQ ID NO: 2115 - protein, 20 aa, Artificial Sequence
  TNFSF15 (TL1A) binding MRD
PDTVCWDDHLGKLMFCSSIM

SEQ ID NO: 2116 - protein, 20 aa, Artificial Sequence
  TNFSF15 (TL1A) binding MRD
RNHVCWDEYTEKLRFCGDGA

SEQ ID NO: 2117 - protein, 20 aa, Artificial Sequence
  TNFSF15 (TL1A) binding MRD
HSDVCWDDHMDKLAFCWHMI

SEQ ID NO: 2118 - protein, 20 aa, Artificial Sequence
  TNFSF15 (TL1A) binding MRD
FTAVCWDYHSNKLQFCSTLM

SEQ ID NO: 2119 - protein, 20 aa, Artificial Sequence
  TNFSF15 (TL1A) binding MRD
DYAVCWDDVRGKLVWCKGLK

SEQ ID NO: 2120 - protein, 20 aa, Artificial Sequence
  TNFSF15 (TL1A) binding MRD
EYDLCWDEIRQKLEWCQGLT

SEQ ID NO: 2121 - protein, 20 aa, Artificial Sequence
  TNFSF15 (TL1A) binding MRD
EYAVCWDAENEKLEWCEGLN

SEQ ID NO: 2122 - protein, 20 aa, Artificial Sequence
  TNFSF15 (TL1A) binding MRD
KHFVCWDELNEKLVWCKGLI

SEQ ID NO: 2123 - protein, 20 aa, Artificial Sequence
  TNFSF15 (TL1A) binding MRD
EYAVCWNEDHAKLEWCQELN

SEQ ID NO: 2124 - protein, 20 aa, Artificial Sequence
  TNFSF15 (TL1A) binding MRD
LSMVCWDQHQERLVFCINRM

SEQ ID NO: 2125 - protein, 20 aa, Artificial Sequence
  TNFSF15 (TL1A) binding MRD
AQYVCWDDKEQKLKFCEDQM

SEQ ID NO: 2126 - protein, 20 aa, Artificial Sequence
  TNFSF15 (TL1A) binding MRD
RYAVCWDESTEKLVYCQNQM

SEQ ID NO: 2127 - protein, 20 aa, Artificial Sequence
  TNFSF15 (TL1A) binding MRD
NEFVCWDEYKNKLVFCVPTL

SEQ ID NO: 2128 - protein, 20 aa, Artificial Sequence
  TNFSF15 (TL1A) binding MRD
RFFVCWDHDNSKLVFCSQNM

SEQ ID NO: 2129 - protein, 20 aa, Artificial Sequence
  TNFSF15 (TL1A) binding MRD
RYAVCWDEAQEKLVWCGRVN

SEQ ID NO: 2130 - protein, 20 aa, Artificial Sequence
  TNFSF15 (TL1A) binding MRD
AFDVCWVEALEKLEWCLGHN

SEQ ID NO: 2131 - protein, 20 aa, Artificial Sequence
  TNFSF15 (TL1A) binding MRD
SSDVCWEAHSEKLYFCDPAR

SEQ ID NO: 2132 - protein, 20 aa, Artificial Sequence
  TNFSF15 (TL1A) binding MRD
KLYVCWDKYKEKLVFCQALM

SEQ ID NO: 2133 - protein, 20 aa, Artificial Sequence
  TNFSF15 (TL1A) binding MRD
KSEVCWDYDMNKLMFCFYDM

SEQ ID NO: 2134 - protein, 20 aa, Artificial Sequence
  TNFSF15 (TL1A) binding MRD
LDAVCWDTQQQKLRFCHTHM

SEQ ID NO: 2135 - protein, 20 aa, Artificial Sequence
  TNFSF15 (TL1A) binding MRD
RSDVCWDAHLDKLIFCAGVM

SEQ ID NO: 2136 - protein, 20 aa, Artificial Sequence
  TNFSF15 (TL1A) binding MRD
DHAVCWNEFQEKLDWCTGLN

SEQ ID NO: 2137 - protein, 20 aa, Artificial Sequence
  TNFSF15 (TL1A) binding MRD
QNDVCWDYHRGKLAFCEALI

SEQ ID NO: 2138 - protein, 20 aa, Artificial Sequence
  TNFSF15 (TL1A) binding MRD
DTDVCWDHVQGKLYFCTKSL

SEQ ID NO: 2139 - protein, 20 aa, Artificial Sequence
  TNFSF15 (TL1A) binding MRD
TSDVCWNYHYSKLQFCQQSM

SEQ ID NO: 2140 - protein, 20 aa, Artificial Sequence
  TNFSF15 (TL1A) binding MRD
LQDVCWDLYYQKLYFCHQPM

SEQ ID NO: 2141 - protein, 20 aa, Artificial Sequence
  TNFSF15 (TL1A) binding MRD
STDVCWDRDHDKLMFCMSVR

SEQ ID NO: 2142 - protein, 20 aa, Artificial Sequence
  TNFSF15 (TL1A) binding MRD
DYAVCWDEAQGKLGWCIGMN

SEQ ID NO: 2143 - protein, 20 aa, Artificial Sequence
  TNFSF15 (TL1A) binding MRD
EYAVCWDDAQERLEWCKEPL

SEQ ID NO: 2144 - protein, 20 aa, Artificial Sequence
  TNFSF15 (TL1A) binding MRD
EYAVCWDESLEKLEWCTGLY

SEQ ID NO: 2145 - protein, 20 aa, Artificial Sequence
  TNFSF15 (TL1A) binding MRD
EYAVCWDEAQQRLIWCKGLY

SEQ ID NO: 2146 - protein, 20 aa, Artificial Sequence
  TNFSF15 (TL1A) binding MRD
EYALCWDQDKEILHWCVEFY

SEQ ID NO: 2147 - protein, 20 aa, Artificial Sequence
  TNFSF15 (TL1A) binding MRD
DNEVCWDGHVDRLVFCDSTM

SEQ ID NO: 2148 - protein, 20 aa, Artificial Sequence
  TNFSF15 (TL1A) binding MRD
NHDVCWDFHVDRLVYCDTPI

SEQ ID NO: 2149 - protein, 20 aa, Artificial Sequence
  TNFSF15 (TL1A) binding MRD
DYAVCWDAHMDHLVYCDAIA

SEQ ID NO: 2150 - protein, 20 aa, Artificial Sequence
  TNFSF15 (TL1A) binding MRD
DYEVCWDDYADRLVYCDLSL

SEQ ID NO: 2151 - protein, 20 aa, Artificial Sequence
  TNFSF15 (TL1A) binding MRD
SYEVCWDVHLDRLVYCNSVM

SEQ ID NO: 2152 - protein, 20 aa, Artificial Sequence
  TNFSF15 (TL1A) binding MRD
HYAVCWDFHLDRLVYCDRPS

SEQ ID NO: 2153 - protein, 20 aa, Artificial Sequence
  TNFSF15 (TL1A) binding MRD
DYEVCWDVIRGRLVYCETPM

SEQ ID NO: 2154 - protein, 20 aa, Artificial Sequence
  TNFSF15 (TL1A) binding MRD
AYEVCWDVNLDRLVYCEALM

SEQ ID NO: 2155 - protein, 20 aa, Artificial Sequence
  TNFSF15 (TL1A) binding MRD
GYEVCWDLKWDRLVFCDAPI

SEQ ID NO: 2156 - protein, 20 aa, Artificial Sequence
  TNFSF15 (TL1A) binding MRD
ALEVCWDFDVDHLVYCAAAL

SEQ ID NO: 2157 - protein, 20 aa, Artificial Sequence
  TNFSF15 (TL1A) binding MRD
EFEVCWDVHLDRLVYCHATM

SEQ ID NO: 2158 - protein, 20 aa, Artificial Sequence
  TNFSF15 (TL1A) binding MRD
QYDVCWDIYSDRLVYCDAHL

SEQ ID NO: 2159 - protein, 20 aa, Artificial Sequence
  TNFSF15 (TL1A) binding MRD
DYEVCWDLYLGRLYYCNAPI

SEQ ID NO: 2160 - protein, 20 aa, Artificial Sequence
  TNFSF15 (TL1A) binding MRD
EYEVCWDVNVDRLVYCNMPN

SEQ ID NO: 2161 - protein, 20 aa, Artificial Sequence
  TNFSF15 (TL1A) binding MRD
DYEVCWDVHFDRLVYCDTPL

SEQ ID NO: 2162 - protein, 20 aa, Artificial Sequence
  TNFSF15 (TL1A) binding MRD
DYEVCWSDDLDRLVYCQALI

SEQ ID NO: 2163 - protein, 20 aa, Artificial Sequence
  TNFSF15 (TL1A) binding MRD
DDAVCWDYHLDRLVFCETPM

SEQ ID NO: 2164 - protein, 20 aa, Artificial Sequence
  TNFSF15 (TL1A) binding MRD
DYDVCWDIHLDRLVYCDGPL

SEQ ID NO: 2165 - protein, 20 aa, Artificial Sequence
  TNFSF15 (TL1A) binding MRD
DYEVCWDVQLDRLVYCDGAM

SEQ ID NO: 2166 - protein, 20 aa, Artificial Sequence
  TNFSF15 (TL1A) binding MRD
DYEVCWDVHVERLVYCEDLI

SEQ ID NO: 2167 - protein, 20 aa, Artificial Sequence
  TNFSF15 (TL1A) binding MRD
DYAVCWDVYADRLIYCEVPM

SEQ ID NO: 2168 - protein, 20 aa, Artificial Sequence
  TNFSF15 (TL1A) binding MRD
DYEVCWDFDIDRLVYCNPPM

SEQ ID NO: 2169 - protein, 20 aa, Artificial Sequence
  TNFSF15 (TL1A) binding MRD
DYEVCWDVHLDRLVYCDGPL

SEQ ID NO: 2170 - protein, 20 aa, Artificial Sequence
  TNFSF15 (TL1A) binding MRD
DYSVCWDFYFDRLVYCNALF

SEQ ID NO: 2171 - protein, 20 aa, Artificial Sequence
  TNFSF15 (TL1A) binding MRD
DYEVCWDVHVGRLIYCNALI

SEQ ID NO: 2172 - protein, 20 aa, Artificial Sequence
  TNFSF15 (TL1A) binding MRD
SYDVCWDDVVDRLVYCEATL

SEQ ID NO: 2173 - protein, 20 aa, Artificial Sequence
  TNFSF15 (TL1A) binding MRD
DYEVCWDVEVDRLVYCVGHK

SEQ ID NO: 2174 - protein, 20 aa, Artificial Sequence
  TNFSF15 (TL1A) binding MRD
PYEVCWDFHLDRLVFCDADK

SEQ ID NO: 2175 - protein, 20 aa, Artificial Sequence
  TNFSF15 (TL1A) binding MRD
DYEVCWDFLLDRLVYCDAPI

SEQ ID NO: 2176 - protein, 20 aa, Artificial Sequence
  TNFSF15 (TL1A) binding MRD
DWEVCWDVHLDRLVFCETLI

SEQ ID NO: 2177 - protein, 20 aa, Artificial Sequence
  TNFSF15 (TL1A) binding MRD
DYEVCWDFDFDRLVFCEAVM

SEQ ID NO: 2178 - protein, 20 aa, Artificial Sequence
  TNFSF15 (TL1A) binding MRD
DYDVCWDVNADRLVYCNAIL

SEQ ID NO: 2179 - protein, 20 aa, Artificial Sequence
  TNFSF15 (TL1A) binding MRD
NHDVCWEFHLDRLVYCDGPS

SEQ ID NO: 2180 - protein, 20 aa, Artificial Sequence
  TNFSF15 (TL1A) binding MRD
DYEVCWDVQLEHLVYCEAPI

SEQ ID NO: 2181 - protein, 20 aa, Artificial Sequence
  TNFSF15 (TL1A) binding MRD
DDQVCWDVKIDRLVYCEALM

SEQ ID NO: 2182 - protein, 20 aa, Artificial Sequence
  TNFSF15 (TL1A) binding MRD
HSDVCWDFDIDRLVFCDTLI

SEQ ID NO: 2183 - protein, 20 aa, Artificial Sequence
  TNFSF15 (TL1A) binding MRD
DYEVCWDIHLDRLVYCNTPM

SEQ ID NO: 2184 - protein, 20 aa, Artificial Sequence
  TNFSF15 (TL1A) binding MRD
DYDVCWDEDVDRLVYCEPPI

SEQ ID NO: 2185 - protein, 20 aa, Artificial Sequence
  TNFSF15 (TL1A) binding MRD
DYEVCWDFDLDRLVYCDSDV

SEQ ID NO: 2186 - protein, 20 aa, Artificial Sequence
  TNFSF15 (TL1A) binding MRD
DYEVCWDDHLDRLVYCDAPG

SEQ ID NO: 2187 - protein, 20 aa, Artificial Sequence
  TNFSF15 (TL1A) binding MRD
DYDVCWDFDLDRLVYCSGPL

SEQ ID NO: 2188 - protein, 20 aa, Artificial Sequence
  TNFSF15 (TL1A) binding MRD
DYEVCWDDHVDRLVYCDRTL

SEQ ID NO: 2189 - protein, 20 aa, Artificial Sequence
  TNFSF15 (TL1A) binding MRD
DYEVCWDPHVDRLVYCDAPA

SEQ ID NO: 2190 - protein, 20 aa, Artificial Sequence
  TNFSF15 (TL1A) binding MRD
HYEVCWDAHFDRLVYCEAPI

SEQ ID NO: 2191 - protein, 20 aa, Artificial Sequence
  TNFSF15 (TL1A) binding MRD
DLEVCWDFDVDRLVYCEAPI

SEQ ID NO: 2192 - protein, 20 aa, Artificial Sequence
  TNFSF15 (TL1A) binding MRD
GFEVCWDVDLDRLVFCAASE

SEQ ID NO: 2193 - protein, 20 aa, Artificial Sequence
  TNFSF15 (TL1A) binding MRD
SYAVCWDFDLERLVYCEIPL

SEQ ID NO: 2194 - protein, 20 aa, Artificial Sequence
  TNFSF15 (TL1A) binding MRD
DHEVCWDFELDRLVYCYKAK

SEQ ID NO: 2195 - protein, 20 aa, Artificial Sequence
  TNFSF15 (TL1A) binding MRD
KYEVCWDEHIDRLVYCDVPM

SEQ ID NO: 2196 - protein, 20 aa, Artificial Sequence
  TNFSF15 (TL1A) binding MRD
YSDVCWDFDLDRLVYCEAHL

SEQ ID NO: 2197 - protein, 20 aa, Artificial Sequence
  TNFSF15 (TL1A) binding MRD
DYEVCWDVNLDRLVYCAGPM

SEQ ID NO: 2198 - protein, 20 aa, Artificial Sequence
  TNFSF15 (TL1A) binding MRD
HYDVCWDDQVDRLVYCHAPL

SEQ ID NO: 2199 - protein, 20 aa, Artificial Sequence
  TNFSF15 (TL1A) binding MRD
EYDVCWDFDIDRLVYCVPLS

SEQ ID NO: 2200 - protein, 20 aa, Artificial Sequence
  TNFSF15 (TL1A) binding MRD
YYEVCWDLNLDRLVYCDVNK

SEQ ID NO: 2201 - protein, 20 aa, Artificial Sequence
  TNFSF15 (TL1A) binding MRD
NYQVCWDFDLDRLVYCGAHK

SEQ ID NO: 2202 - protein, 20 aa, Artificial Sequence
  TNFSF15 (TL1A) binding MRD
DYEVCWDVYFGRLVYCDVLM

SEQ ID NO: 2203 - protein, 20 aa, Artificial Sequence
  TNFSF15 (TL1A) binding MRD
EYVVCWDTEVDHLVYCDAAM

SEQ ID NO: 2204 - protein, 20 aa, Artificial Sequence
  TNFSF15 (TL1A) binding MRD
YSDVCWDFYYDRLVYCDASI

SEQ ID NO: 2205 - protein, 20 aa, Artificial Sequence
  TNFSF15 (TL1A) binding MRD
DYEVCWDVDVDRLVYCDGPK

SEQ ID NO: 2206 - protein, 20 aa, Artificial Sequence
  TNFSF15 (TL1A) binding MRD
DYAVCWDDHVEHLVYCDASW

SEQ ID NO: 2207 - protein, 20 aa, Artificial Sequence
  TNFSF15 (TL1A) binding MRD
DYDVCWDFDFERLVFCNSSM

SEQ ID NO: 2208 - protein, 20 aa, Artificial Sequence
  TNFSF15 (TL1A) binding MRD
DYAVCWDDHFDRLVYCDWTT

SEQ ID NO: 2209 - protein, 20 aa, Artificial Sequence
  TNFSF15 (TL1A) binding MRD
DYDVCWDEHLDRLVYCNGLG

SEQ ID NO: 2210 - protein, 20 aa, Artificial Sequence
  TNFSF15 (TL1A) binding MRD
EYEVCWDVNVDRLVWCYATM

SEQ ID NO: 2211 - protein, 20 aa, Artificial Sequence
  TNFSF15 (TL1A) binding MRD
DYEVCWDVHAERLYYCDAPI

SEQ ID NO: 2212 - protein, 20 aa, Artificial Sequence
  TNFSF15 (TL1A) binding MRD
DHEVCWDEHVDRLVYCYKAI

SEQ ID NO: 2213 - protein, 20 aa, Artificial Sequence
  TNFSF15 (TL1A) binding MRD
DYDVCWDDYLDRLVYCEARI

SEQ ID NO: 2214 - protein, 20 aa, Artificial Sequence
  TNFSF15 (TL1A) binding MRD
HYDVCWDYHLDRLVYCNRHM

SEQ ID NO: 2215 - protein, 20 aa, Artificial Sequence
  TNFSF15 (TL1A) binding MRD
DYEVCWDIHLDHLVYCDAPW

SEQ ID NO: 2216 - protein, 20 aa, Artificial Sequence
  TNFSF15 (TL1A) binding MRD
EYDVCWDVDLDRLVYCATTY

SEQ ID NO: 2217 - protein, 20 aa, Artificial Sequence
  TNFSF15 (TL1A) binding MRD
EYEVCWDFQVDRLVYCMAIT

SEQ ID NO: 2218 - protein, 20 aa, Artificial Sequence
  TNFSF15 (TL1A) binding MRD
DYEVCWDIIVDRLVYCEAPP

SEQ ID NO: 2219 - protein, 20 aa, Artificial Sequence
  TNFSF15 (TL1A) binding MRD
YYEVCWDLYLDRLVFCNADL

SEQ ID NO: 2220 - protein, 20 aa, Artificial Sequence
  TNFSF15 (TL1A) binding MRD
DYEVCWDFREDRLVYCDSIM

SEQ ID NO: 2221 - protein, 20 aa, Artificial Sequence
  TNFSF15 (TL1A) binding MRD
DYAVCWDFHLNRLVYCDVPV

SEQ ID NO: 2222 - protein, 20 aa, Artificial Sequence
  TNFSF15 (TL1A) binding MRD
EYDVCWDFQLDRLVYCDSQM

SEQ ID NO: 2223 - protein, 20 aa, Artificial Sequence
  TNFSF15 (TL1A) binding MRD
DYAVCWDFDEDRLVYCVGPL

SEQ ID NO: 2224 - protein, 19 aa, Artificial Sequence
  TNFSF15 (TL1A) binding MRD
SERDCNIQKMRKVPCLVML

SEQ ID NO: 2225 - protein, 18 aa, Artificial Sequence
  TNFSF15 (TL1A) binding MRD
SDWACPMYMHEIECSVRW

SEQ ID NO: 2226 - protein, 16 aa, Artificial Sequence
  TNFSF15 (TL1A) binding MRD
VPEVCQWEFVKCLWNA

SEQ ID NO: 2227 - protein, 17 aa, Artificial Sequence
  TNFSF15 (TL1A) binding MRD
AAWQCLDPEWWVCVMLN

SEQ ID NO: 2228 - protein, 18 aa, Artificial Sequence
  TNFSF15 (TL1A) binding MRD
LVSSCPYGTPSAVCNGMW

SEQ ID NO: 2229 - protein, 18 aa, Artificial Sequence
  TNFSF15 (TL1A) binding MRD
GTVYCQPYMSVMECAFRA

SEQ ID NO: 2230 - protein, 17 aa, Artificial Sequence
  TNFSF15 (TL1A) binding MRD
EDFLCYPAPWVLSAAGT

SEQ ID NO: 2231 - protein, 18 aa, Artificial Sequence
  TNFSF15 (TL1A) binding MRD
VSGGCPSYMNQWECVFRW

SEQ ID NO: 2232 - protein, 16 aa, Artificial Sequence
  TNFSF15 (TL1A) binding MRD
HVELCFDKMRYCIMEL

SEQ ID NO: 2233 - protein, 16 aa, Artificial Sequence
  TNFSF15 (TL1A) binding MRD
TLLACQLKFIKCLNNW

SEQ ID NO: 2234 - protein, 18 aa, Artificial Sequence
  TNFSF15 (TL1A) binding MRD
LVFLCPGYRAQHHCVLLS

SEQ ID NO: 2235 - protein, 20 aa, Artificial Sequence
  TNFSF15 (TL1A) binding MRD
QDRVCWDFHLQKLQFCELSM

SEQ ID NO: 2236 - protein, 19 aa, Artificial Sequence
  TLA525
QDRVCWDFHQKLQFCELSM

SEQ ID NO: 2237 - protein, 20 aa, Artificial Sequence
  TLA27
YSSVCWDDTREALFYCETTV

SEQ ID NO: 2238 - protein, 20 aa, Artificial Sequence
  TLA522
EYALCWVEAQEKLEWCKGLN

SEQ ID NO: 2239 - protein, 20 aa, Artificial Sequence
  TLA523
DYEVCWDVHVDRLVYCDAPM

SEQ ID NO: 2240 - protein, 20 aa, Artificial Sequence
  TLA35
STEVCWDFIEQKLIWCSTFR

SEQ ID NO: 2241 - protein, 20 aa, Artificial Sequence
  TLA54
QSDVCWNQSHQLLQFCWESN

SEQ ID NO: 2242 - protein, 20 aa, Artificial Sequence
  TLA524
DYAVCWDPDYGNLVWCNVLS

SEQ ID NO: 2243 - protein, 20 aa, Artificial Sequence
  BLY50
GDMGCWDWLTRTQVKCSLLV

SEQ ID NO: 2244 - protein, 18 aa, Artificial Sequence
  BLY47
PRGTCWADPLTGQCVQVM

SEQ ID NO: 2245 - protein, 20 aa, Artificial Sequence
  BLY35
PAGMCFDNLTLQMVQCTSLK

SEQ ID NO: 2246 - protein, 18 aa, Artificial Sequence
  BLY69
GPWACYETPTRQMCVPVF

SEQ ID NO: 2247 - protein, 18 aa, Artificial Sequence
  BLY60
ERKACYFDPLVKQCLFVR

SEQ ID NO: 2248 - protein, 18 aa, Artificial Sequence
  BLY34
TMPTCFMDPLTHQCWPSV

SEQ ID NO: 2249 - protein, 20 aa, Artificial Sequence
  BLY31
HPGRCYDQLTYEWVTCWHLW

SEQ ID NO: 2250 - protein, 18 aa, Artificial Sequence
  BLY73
RADLCYHEHHNNECFFGM

SEQ ID NO: 2251 - protein, 20 aa, Artificial Sequence
  BLY27
TGSSCWDILTKQMVPCLTAW

SEQ ID NO: 2252 - protein, 19 aa, Artificial Sequence
  EGFR binding MRD
WEFQCHFYDESMFECTLSP

SEQ ID NO: 2253 - protein, 17 aa, Artificial Sequence
  EGFR binding MRD
WLSMCPHFYHQKCRFWK

SEQ ID NO: 2254 - protein, 18 aa, Artificial Sequence
  EGFR binding MRD
SRILCMVNPYWMACWLET

SEQ ID NO: 2255 - protein, 20 aa, Artificial Sequence
  EGFR binding MRD
GMRRCIWEYVMKHQACAPIF

SEQ ID NO: 2256 - protein, 19 aa, Artificial Sequence
  EGFR binding MRD
HLCGCYLELPGVLLCYCFS

SEQ ID NO: 2257 - protein, 18 aa, Artificial Sequence
  EGFR binding MRD
ARLLCVVYPGFVACVVQQ

SEQ ID NO: 2258 - protein, 19 aa, Artificial Sequence
  EGFR binding MRD
VAFRCIIDEMYYMTCWEVE

SEQ ID NO: 2259 - protein, 19 aa, Artificial Sequence
  EGFR binding MRD
GLHGCQYVQMFFHFCAPKT

SEQ ID NO: 2260 - protein, 18 aa, Artificial Sequence
  EGFR binding MRD
LLMFCHSMWWWPNCYSCV

SEQ ID NO: 2261 - protein, 17 aa, Artificial Sequence
  EGFR binding MRD
LSLRCTSEMWWGCYLVA

SEQ ID NO: 2262 - protein, 18 aa, Artificial Sequence
  EGFR binding MRD
EKMYCTYTHFFHMCYLPP

SEQ ID NO: 2263 - protein, 15 aa, Artificial Sequence
  EGFR binding MRD
LGVICIHWNYCKTFV

SEQ ID NO: 2264 - protein, 17 aa, Artificial Sequence
  EGFR binding MRD
SVLGCDDVGFYQCLEFL

SEQ ID NO: 2265 - protein, 20 aa, Artificial Sequence
  EGFR binding MRD
LLILCFHHQLEWKWTCLTME

SEQ ID NO: 2266 - protein, 18 aa, Artificial Sequence
  EGFR binding MRD
HSGQCTWEVWGRECWYQN

SEQ ID NO: 2267 - protein, 18 aa, Artificial Sequence
  EGFR binding MRD
QMDTCTWEVWGRDCIQWA

SEQ ID NO: 2268 - protein, 18 aa, Artificial Sequence
  EGFR binding MRD
DAWGCTWQVWGRECSDPG

SEQ ID NO: 2269 - protein, 18 aa, Artificial Sequence
  EGFR binding MRD
HEVGCTWEVWGRDCEQIR

SEQ ID NO: 2270 - protein, 18 aa, Artificial Sequence
  EGFR binding MRD
DPWGCTWEVWGRECPLNL

SEQ ID NO: 2271 - protein, 18 aa, Artificial Sequence
  EGFR binding MRD
DLHGCTWEIWGRECQIRH

SEQ ID NO: 2272 - protein, 18 aa, Artificial Sequence
  EGFR binding MRD
DPGGCTWEVWGRECQNSM

SEQ ID NO: 2273 - protein, 18 aa, Artificial Sequence
  EGFR binding MRD
DMFGCTWEVWGRECPSPQ

SEQ ID NO: 2274 - protein, 18 aa, Artificial Sequence
  EGFR binding MRD
DAWGCTWEIWGRECARSY

SEQ ID NO: 2275 - protein, 18 aa, Artificial Sequence
  EGFR binding MRD
TSDSCTWEIWGRECYMQR

SEQ ID NO: 2276 - protein, 18 aa, Artificial Sequence
  EGFR binding MRD
DQYGCTWEVWGRECVGGA

SEQ ID NO: 2277 - protein, 18 aa, Artificial Sequence
  EGFR binding MRD
DQYGCIWEQWGRECFVNT

SEQ ID NO: 2278 - protein, 18 aa, Artificial Sequence
  EGFR binding MRD
DNDGCTWEVWGRECHQFK

SEQ ID NO: 2279 - protein, 18 aa, Artificial Sequence
  EGFR binding MRD
EYDGCTWEVWGRECHESS

SEQ ID NO: 2280 - protein, 18 aa, Artificial Sequence
  EGFR binding MRD
GAGNCTWEIWGRDCPQDV

SEQ ID NO: 2281 - protein, 18 aa, Artificial Sequence
  EGFR binding MRD
TVDRCTWEVWGRECSQNG

SEQ ID NO: 2282 - protein, 18 aa, Artificial Sequence
  EGFR binding MRD
LADNCTWEVWGRECPITE

SEQ ID NO: 2283 - protein, 18 aa, Artificial Sequence
  EGFR binding MRD
DNYGCTWEVWGRDCSKSP

SEQ ID NO: 2284 - protein, 18 aa, Artificial Sequence
  EGFR binding MRD
DAHGCHWEVWGRECTRTA

SEQ ID NO: 2285 - protein, 18 aa, Artificial Sequence
  EGFR binding MRD
SSDLCTWEIWGRECYSGY

SEQ ID NO: 2286 - protein, 18 aa, Artificial Sequence
  EGFR binding MRD
DDFGCYWKGWGRECHLPL

SEQ ID NO: 2287 - protein, 18 aa, Artificial Sequence
  EGFR binding MRD
DWWGCTWEVWGRECLQLE

SEQ ID NO: 2288 - protein, 18 aa, Artificial Sequence
  EGFR binding MRD
DAHGCTWEVWGRECGQWA

SEQ ID NO: 2289 - protein, 18 aa, Artificial Sequence
  EGFR binding MRD
DAFGCTWEVWGRECRHVV

SEQ ID NO: 2290 - protein, 18 aa, Artificial Sequence
  EGFR binding MRD
DAWGCTWEIWGRDCAADN

SEQ ID NO: 2291 - protein, 18 aa, Artificial Sequence
  EGFR binding MRD
DASGCTWEVWGRECMMWH

SEQ ID NO: 2292 - protein, 18 aa, Artificial Sequence
  EGFR binding MRD
DPWACTWEVWGRECNHVG

SEQ ID NO: 2293 - protein, 18 aa, Artificial Sequence
  EGFR binding MRD
ASDNCTWEVWGRECQLWG

SEQ ID NO: 2294 - protein, 18 aa, Artificial Sequence
  EGFR binding MRD
DMYGCTWEIWGRECHIND

SEQ ID NO: 2295 - protein, 18 aa, Artificial Sequence
  EGFR binding MRD
DSWGCRWEVWGRECGSDI

SEQ ID NO: 2296 - protein, 18 aa, Artificial Sequence
  EGFR binding MRD
NPDGCTWEVWGRECYSNR

SEQ ID NO: 2297 - protein, 18 aa, Artificial Sequence
  EGFR binding MRD
DFFGCTWEIWGRECYWEF

SEQ ID NO: 2298 - protein, 18 aa, Artificial Sequence
  EGFR binding MRD
SSSFCTWEVWGRDCPQDQ

SEQ ID NO: 2299 - protein, 18 aa, Artificial Sequence
  EGFR binding MRD
AADRCTWEVWGRDCPQTH

SEQ ID NO: 2300 - protein, 18 aa, Artificial Sequence
  EGFR binding MRD
LVDLCTWEVWGRECWYSD

SEQ ID NO: 2301 - protein, 18 aa, Artificial Sequence
  EGFR binding MRD
DSYGCTWEVWGRECPMDT

SEQ ID NO: 2302 - protein, 18 aa, Artificial Sequence
  EGFR binding MRD
DNWGCTWEVWGRDCHYGT

SEQ ID NO: 2303 - protein, 18 aa, Artificial Sequence
  EGFR binding MRD
PDFGCTWEVWGRECYGVN

SEQ ID NO: 2304 - protein, 18 aa, Artificial Sequence
  EGFR binding MRD
QSTQCTWEVWGRECHQMR

SEQ ID NO: 2305 - protein, 18 aa, Artificial Sequence
  EGFR binding MRD
LPPGCTWEVWGRDCLHPR

SEQ ID NO: 2306 - protein, 18 aa, Artificial Sequence
  EGFR binding MRD
GEVDCTWEVWGRECYNGW

SEQ ID NO: 2307 - protein, 18 aa, Artificial Sequence
  EGFR binding MRD
LTVGCTWEVWGRECWQQP

SEQ ID NO: 2308 - protein, 18 aa, Artificial Sequence
  EGFR binding MRD
DDDGCTWEVWGRECRLPA

SEQ ID NO: 2309 - protein, 18 aa, Artificial Sequence
  EGFR binding MRD
SLLSCTWEVWGRDCSAFY

SEQ ID NO: 2310 - protein, 18 aa, Artificial Sequence
  EGFR binding MRD
KDKECTWEVWGRECWQDR

SEQ ID NO: 2311 - protein, 18 aa, Artificial Sequence
  EGFR binding MRD
DQGGCTWQVWGRDCRSNP

SEQ ID NO: 2312 - protein, 18 aa, Artificial Sequence
  EGFR binding MRD
DHYGCTWEVWGRECWTVG

SEQ ID NO: 2313 - protein, 18 aa, Artificial Sequence
  EGFR binding MRD
DAFGCTWAVWGRECRHDQ

SEQ ID NO: 2314 - protein, 18 aa, Artificial Sequence
  EGFR binding MRD
YGDSCTWEVWGRECMMGR

SEQ ID NO: 2315 - protein, 18 aa, Artificial Sequence
  EGFR binding MRD
TADPCTWEVWGRECHMRP

SEQ ID NO: 2316 - protein, 18 aa, Artificial Sequence
  EGFR binding MRD
QDWGCTWEVWGRDCQQYT

SEQ ID NO: 2317 - protein, 18 aa, Artificial Sequence
  EGFR binding MRD
DSWGCTWEIWGRECWGTE

SEQ ID NO: 2318 - protein, 18 aa, Artificial Sequence
  EGFR binding MRD
SVDFCTWEVWGRECYWYP

SEQ ID NO: 2319 - protein, 18 aa, Artificial Sequence
  EGFR binding MRD
AGDGCTWEVWGRECLQES

SEQ ID NO: 2320 - protein, 18 aa, Artificial Sequence
  EGFR binding MRD
MWPNCTWEVWGRDCAWYH

SEQ ID NO: 2321 - protein, 18 aa, Artificial Sequence
  EGFR binding MRD
DEYGCSWEVWGRECHTTL

SEQ ID NO: 2322 - protein, 18 aa, Artificial Sequence
  EGFR binding MRD
DQWGCTWEVWGRECAFNS

SEQ ID NO: 2323 - protein, 18 aa, Artificial Sequence
  EGFR binding MRD
SSDPCTWEVWGRECPQGP

SEQ ID NO: 2324 - protein, 18 aa, Artificial Sequence
  EGFR binding MRD
LVLGCWWEVWGRECGSTA

SEQ ID NO: 2325 - protein, 18 aa, Artificial Sequence
  EGFR binding MRD
KADHCTWEIWGRECAQYT

SEQ ID NO: 2326 - protein, 18 aa, Artificial Sequence
  EGFR binding MRD
DDWGCSWEVWGRECQIPK

SEQ ID NO: 2327 - protein, 18 aa, Artificial Sequence
  EGFR binding MRD
PKYGCTWEIWGRECWHST

SEQ ID NO: 2328 - protein, 18 aa, Artificial Sequence
  EGFR binding MRD
SNLGCTWELWGRDCSLYY

SEQ ID NO: 2329 - protein, 18 aa, Artificial Sequence
  EGFR binding MRD
DAYGCYWELWGRDCHQIV

SEQ ID NO: 2330 - protein, 18 aa, Artificial Sequence
  EGFR binding MRD
DYWGCTWEVWGRECTTNP

SEQ ID NO: 2331 - protein, 18 aa, Artificial Sequence
  EGFR binding MRD
DIWNCTWEVWGRECYLNQ

SEQ ID NO: 2332 - protein, 18 aa, Artificial Sequence
  EGFR binding MRD
SWSLCTWEVWGRDCYWQK

SEQ ID NO: 2333 - protein, 18 aa, Artificial Sequence
  EGFR binding MRD
DIWGCTWEVWGRECLNYY

SEQ ID NO: 2334 - protein, 18 aa, Artificial Sequence
  EGFR binding MRD
TNGFCTWEVWGRECWYGS

SEQ ID NO: 2335 - protein, 18 aa, Artificial Sequence
  EGFR binding MRD
DLYGCTWEIWGRECHITG

SEQ ID NO: 2336 - protein, 18 aa, Artificial Sequence
  EGFR binding MRD
DENGCTWEVWGRECYIQR

SEQ ID NO: 2337 - protein, 18 aa, Artificial Sequence
  EGFR binding MRD
DSFGCTWEVWGRECHPQL

SEQ ID NO: 2338 - protein, 18 aa, Artificial Sequence
  EGFR binding MRD
NHDFCTWEVWGRECWPNA

SEQ ID NO: 2339 - protein, 18 aa, Artificial Sequence
  EGFR binding MRD
DEHGCTWEVWGRECHRPG

SEQ ID NO: 2340 - protein, 18 aa, Artificial Sequence
  EGFR binding MRD
DHHGCTWEVWGRDCYWAI

SEQ ID NO: 2341 - protein, 18 aa, Artificial Sequence
  EGFR binding MRD
WQDNCWWEVWGRECLGDR

SEQ ID NO: 2342 - protein, 18 aa, Artificial Sequence
  EGFR binding MRD
PTDTCTWEVWGRECYWIR

SEQ ID NO: 2343 - protein, 18 aa, Artificial Sequence
  EGFR binding MRD
YQDPCTWEIWGRDCHQGM

SEQ ID NO: 2344 - protein, 18 aa, Artificial Sequence
  EGFR binding MRD
DRWGCTWEIWGRECHQDN

SEQ ID NO: 2345 - protein, 18 aa, Artificial Sequence
  EGFR binding MRD
DLWGCTWEVWGRECFVVN

SEQ ID NO: 2346 - protein, 18 aa, Artificial Sequence
  EGFR binding MRD
GLDGCTWEVWGRECYQGS

SEQ ID NO: 2347 - protein, 18 aa, Artificial Sequence
  EGFR binding MRD
LPIPCYWTTWGKECFMPR

SEQ ID NO: 2348 - protein, 18 aa, Artificial Sequence
  EGFR binding MRD
LPDPCYWTTWGKECFMFR

SEQ ID NO: 2349 - protein, 18 aa, Artificial Sequence
  EGFR binding MRD
LADPCYWTTWGKECVIPR

SEQ ID NO: 2350 - protein, 18 aa, Artificial Sequence
  EGFR binding MRD
LTVPCYWTTWGKECFLPR

SEQ ID NO: 2351 - protein, 18 aa, Artificial Sequence
  EGFR binding MRD
LPAPCYWTTWGKECFILR

SEQ ID NO: 2352 - protein, 18 aa, Artificial Sequence
  EGFR binding MRD
LPAPCYWTTWGKECHMPR

SEQ ID NO: 2353 - protein, 18 aa, Artificial Sequence
  EGFR binding MRD
LPAPCFWTTWGKECFLFR

SEQ ID NO: 2354 - protein, 18 aa, Artificial Sequence
  EGFR binding MRD
LAAPCYWTTWGKECYMPR

SEQ ID NO: 2355 - protein, 18 aa, Artificial Sequence
  EGFR binding MRD
PTSPCYWTTWGKECYLLR

SEQ ID NO: 2356 - protein, 18 aa, Artificial Sequence
  EGFR binding MRD
ITPPCYWTSWGKECHLFR

SEQ ID NO: 2357 - protein, 18 aa, Artificial Sequence
  EGFR binding MRD
LPAPCYWTTWGKECFMLR

SEQ ID NO: 2358 - protein, 18 aa, Artificial Sequence
  EGFR binding MRD
LTEPCYWTTWGKECFLPV

SEQ ID NO: 2359 - protein, 18 aa, Artificial Sequence
  EGFR binding MRD
LPAGCYWTTWGKECFMHN

SEQ ID NO: 2360 - protein, 18 aa, Artificial Sequence
  EGFR binding MRD
ITSPCYWTTWGKECFIFP

SEQ ID NO: 2361 - protein, 18 aa, Artificial Sequence
  EGFR binding MRD
LPAPCYWTTWGKECLLFG

SEQ ID NO: 2362 - protein, 18 aa, Artificial Sequence
  EGFR binding MRD
LPAPCYWTTWGKECFMPQ

SEQ ID NO: 2363 - protein, 18 aa, Artificial Sequence
  EGFR binding MRD
LPAPCYWTTWGKECFILS

SEQ ID NO: 2364 - protein, 18 aa, Artificial Sequence
  EGFR binding MRD
LPTPCYWTTWGKECYVYG

SEQ ID NO: 2365 - protein, 18 aa, Artificial Sequence
  EGFR binding MRD
LPAPCYWTTWGKECYMLP

SEQ ID NO: 2366 - protein, 18 aa, Artificial Sequence
  EGFR binding MRD
LTPPCYWTTWGKECFMFP

SEQ ID NO: 2367 - protein, 18 aa, Artificial Sequence
  EGFR binding MRD
LSTQCYWTTWGKECYLFP

SEQ ID NO: 2368 - protein, 18 aa, Artificial Sequence
  EGFR binding MRD
LPAPCYWTTWGKECLMLR

SEQ ID NO: 2369 - protein, 18 aa, Artificial Sequence
  EGFR binding MRD
LPYPCYWTTWGKECFMHR

SEQ ID NO: 2370 - protein, 18 aa, Artificial Sequence
  EGFR binding MRD
LAAPCYWTTWGKECLMIR

SEQ ID NO: 2371 - protein, 18 aa, Artificial Sequence
  EGFR binding MRD
LTAPCYWTTWGKECYLFH

SEQ ID NO: 2372 - protein, 18 aa, Artificial Sequence
  EGFR binding MRD
LPAPCYWTTWGKECVLGV

SEQ ID NO: 2373 - protein, 18 aa, Artificial Sequence
  EGFR binding MRD
LPFPCYWTVWGKECFMPR

SEQ ID NO: 2374 - protein, 18 aa, Artificial Sequence
  EGFR binding MRD
LSPPCYWTIWGKECHMLQ

SEQ ID NO: 2375 - protein, 18 aa, Artificial Sequence
  EGFR binding MRD
PNDPCYWTTWGRECLLGR

SEQ ID NO: 2376 - protein, 18 aa, Artificial Sequence
  EGFR binding MRD
LPPPCYWTTWGKECQMFD

SEQ ID NO: 2377 - protein, 18 aa, Artificial Sequence
  EGFR binding MRD
LTDPCYWTIWGRECLLPS

SEQ ID NO: 2378 - protein, 18 aa, Artificial Sequence
  EGFR binding MRD
FNEPCYWTTWGKECYLPR

SEQ ID NO: 2379 - protein, 18 aa, Artificial Sequence
  EGFR binding MRD
LPAPCYWTNWGKECFMMR

SEQ ID NO: 2380 - protein, 18 aa, Artificial Sequence
  EGFR binding MRD
FPDPCYWTTWGRECLLPR

SEQ ID NO: 2381 - protein, 18 aa, Artificial Sequence
  EGFR binding MRD
VTSGCYWTTWGKECFLPR

SEQ ID NO: 2382 - protein, 18 aa, Artificial Sequence
  EGFR binding MRD
STAACYWTTWGKECYMPR

SEQ ID NO: 2383 - protein, 18 aa, Artificial Sequence
  EGFR binding MRD
LPGGCYWTTWGKECFMPR

SEQ ID NO: 2384 - protein, 18 aa, Artificial Sequence
  EGFR binding MRD
IITPCYWTTWGKECYLIP

SEQ ID NO: 2385 - protein, 18 aa, Artificial Sequence
  EGFR binding MRD
TADPCYWTIWGRECVMSR

SEQ ID NO: 2386 - protein, 18 aa, Artificial Sequence
  EGFR binding MRD
LADQCYWTTWGKECYLGL

SEQ ID NO: 2387 - protein, 18 aa, Artificial Sequence
  EGFR binding MRD
LTDPCYWTVWGRECFLLR

SEQ ID NO: 2388 - protein, 18 aa, Artificial Sequence
  EGFR binding MRD
IDAACYWTTWGKECLLPR

SEQ ID NO: 2389 - protein, 18 aa, Artificial Sequence
  EGFR binding MRD
LTAPCYWTTWGKECFLLR

SEQ ID NO: 2390 - protein, 18 aa, Artificial Sequence
  EGFR binding MRD
LPVPCYWTTWGKECLMLR

SEQ ID NO: 2391 - protein, 18 aa, Artificial Sequence
  EGFR binding MRD
VTDSCYWTTWGRECYLPH

SEQ ID NO: 2392 - protein, 18 aa, Artificial Sequence
  EGFR binding MRD
LPAGCYWTTWGKECYMFA

SEQ ID NO: 2393 - protein, 18 aa, Artificial Sequence
  EGFR binding MRD
FTDPCYWTVWGRECLLPR

SEQ ID NO: 2394 - protein, 18 aa, Artificial Sequence
  EGFR binding MRD
LTAPCYWTTWGKECLILR

SEQ ID NO: 2395 - protein, 18 aa, Artificial Sequence
  EGFR binding MRD
VTDPCYWTTWGRECLMLP

SEQ ID NO: 2396 - protein, 18 aa, Artificial Sequence
  EGFR binding MRD
LTSPCYWTTWGKECFMLN

SEQ ID NO: 2397 - protein, 18 aa, Artificial Sequence
  EGFR binding MRD
LPVPCYWTTWGKECLMFP

SEQ ID NO: 2398 - protein, 18 aa, Artificial Sequence
  EGFR binding MRD
TADPCYWTTWGRECLMPR

SEQ ID NO: 2399 - protein, 18 aa, Artificial Sequence
  EGFR binding MRD
LTAPCYWTIWGKECYLLP

SEQ ID NO: 2400 - protein, 18 aa, Artificial Sequence
  EGFR binding MRD
LAPPCYWTIWGKECLLLR

SEQ ID NO: 2401 - protein, 18 aa, Artificial Sequence
  EGFR binding MRD
LPSPCYWTTWGKECFMPR

SEQ ID NO: 2402 - protein, 18 aa, Artificial Sequence
  EGFR binding MRD
VTDGCYWTTWGKECLMPR

SEQ ID NO: 2403 - protein, 18 aa, Artificial Sequence
  EGFR binding MRD
LPDDCYWTTWGKECYLQR

SEQ ID NO: 2404 - protein, 18 aa, Artificial Sequence
  EGFR binding MRD
DIDPCWWAPWGRECLMVR

SEQ ID NO: 2405 - protein, 18 aa, Artificial Sequence
  EGFR binding MRD
TPDPCWWATWGRECILDR

SEQ ID NO: 2406 - protein, 18 aa, Artificial Sequence
  EGFR binding MRD
LPAPCFWTTWGKECFLLR

SEQ ID NO: 2407 - protein, 18 aa, Artificial Sequence
  EGFR binding MRD
DNDPCYWTVWGRECLMPL

SEQ ID NO: 2408 - protein, 18 aa, Artificial Sequence
  EGFR binding MRD
LTAPCYWTTWGKECLLLP

SEQ ID NO: 2409 - protein, 18 aa, Artificial Sequence
  EGFR binding MRD
LTVPCYWTTWGKECYLLS

SEQ ID NO: 2410 - protein, 18 aa, Artificial Sequence
  EGFR binding MRD
LIAPCYWTTWGKECYMLP

SEQ ID NO: 2411 - protein, 18 aa, Artificial Sequence
  EGFR binding MRD
LPEPCYWTTWGRECFLPR

SEQ ID NO: 2412 - protein, 18 aa, Artificial Sequence
  EGFR binding MRD
LTTPCYWTIWGKECFLPI

SEQ ID NO: 2413 - protein, 18 aa, Artificial Sequence
  EGFR binding MRD
LPEGCYWTTWGKECFMLR

SEQ ID NO: 2414 - protein, 18 aa, Artificial Sequence
  EGFR binding MRD
LPAPCYWTTWGKECFILL

SEQ ID NO: 2415 - protein, 18 aa, Artificial Sequence
  EGFR binding MRD
LKAPCYWTTWGKECYLLP

SEQ ID NO: 2416 - protein, 18 aa, Artificial Sequence
  EGFR binding MRD
LKDPCYWTTWGRECLMLP

SEQ ID NO: 2417 - protein, 18 aa, Artificial Sequence
  EGFR binding MRD
VRPGCYWTTWGKECFMPG

SEQ ID NO: 2418 - protein, 18 aa, Artificial Sequence
  EGFR binding MRD
PSDPCYWTIWGRECYMIP

SEQ ID NO: 2419 - protein, 18 aa, Artificial Sequence
  EGFR binding MRD
LPAPCYWTVWGKECHMSR

SEQ ID NO: 2420 - protein, 18 aa, Artificial Sequence
  EGFR binding MRD
LSDPCYWTIWGKECFLIL

SEQ ID NO: 2421 - protein, 18 aa, Artificial Sequence
  EGFR binding MRD
LTDHCYWTIWGRECLLPR

SEQ ID NO: 2422 - protein, 18 aa, Artificial Sequence
  EGFR binding MRD
VTDPCYWTTWGRECLLLR

SEQ ID NO: 2423 - protein, 18 aa, Artificial Sequence
  EGFR binding MRD
LPAGCYWTTWGKECHLHL

SEQ ID NO: 2424 - protein, 18 aa, Artificial Sequence
  EGFR binding MRD
LPAPCFWTTWGKECYMFT

SEQ ID NO: 2425 - protein, 18 aa, Artificial Sequence
  EGFR binding MRD
FSDPCYWTTWGRECFWIP

SEQ ID NO: 2426 - protein, 18 aa, Artificial Sequence
  EGFR binding MRD
LSDPCYWTTWGRECFLLP

SEQ ID NO: 2427 - protein, 18 aa, Artificial Sequence
  EGFR binding MRD
FKDPCYWTTWGRECYLLP

SEQ ID NO: 2428 - protein, 18 aa, Artificial Sequence
  EGFR binding MRD
FPDPCYWTIWGRECILPL

SEQ ID NO: 2429 - protein, 18 aa, Artificial Sequence
  EGFR binding MRD
LTDPCHWTIWGRECFLPP

SEQ ID NO: 2430 - protein, 19 aa, Artificial Sequence
  EGFR binding MRD
YDDHCCYLTIWGRECFLPP

SEQ ID NO: 2431 - protein, 18 aa, Artificial Sequence
  EGFR binding MRD
FSDPCIWTTWGRECFWVH

SEQ ID NO: 2432 - protein, 18 aa, Artificial Sequence
  EGFR binding MRD
TRDTCYWTVWGRECFLPP

SEQ ID NO: 2433 - protein, 19 aa, Artificial Sequence
  EGFR binding MRD
HRAPCFSCTACRQPCFSLT

SEQ ID NO: 2434 - protein, 18 aa, Artificial Sequence
  EGFR binding MRD
FDDPCYWTTWGRECLMLP

SEQ ID NO: 2435 - protein, 18 aa, Artificial Sequence
  EGFR binding MRD
HNDPCVWTTWGRECFLLP

SEQ ID NO: 2436 - protein, 18 aa, Artificial Sequence
  EGFR binding MRD
LGDSCFWTTWGRECFLHP

SEQ ID NO: 2437 - protein, 18 aa, Artificial Sequence
  EGFR binding MRD
FSDPCYWTTWGRECLLIP

SEQ ID NO: 2438 - protein, 19 aa, Artificial Sequence
  EGFR binding MRD
CTGPCYWTTWGRECCLSYP

SEQ ID NO: 2439 - protein, 18 aa, Artificial Sequence
  EGFR binding MRD
ASDPCYWTTWGRECFLLP

SEQ ID NO: 2440 - protein, 18 aa, Artificial Sequence
  EGFR binding MRD
LSDPCYWTTWGRECILLQ

SEQ ID NO: 2441 - protein, 18 aa, Artificial Sequence
  EGFR binding MRD
LTDPCHWTIWGRECFLLP

SEQ ID NO: 2442 - protein, 18 aa, Artificial Sequence
  EGFR binding MRD
STDLCYWTIWGRECYLPP

SEQ ID NO: 2443 - protein, 18 aa, Artificial Sequence
  EGFR binding MRD
FSDPCSWTTWGRECFLPP

SEQ ID NO: 2444 - protein, 18 aa, Artificial Sequence
  EGFR binding MRD
WRDPCYWATWGRECYLVP

SEQ ID NO: 2445 - protein, 18 aa, Artificial Sequence
  EGFR binding MRD
LGDPCYWTTWGRECFWLP

SEQ ID NO: 2446 - protein, 18 aa, Artificial Sequence
  EGFR binding MRD
FRDPCYWTTWGRECFLLP

SEQ ID NO: 2447 - protein, 18 aa, Artificial Sequence
  EGFR binding MRD
LIDPCYWTTWGRECFLIP

SEQ ID NO: 2448 - protein, 18 aa, Artificial Sequence
  EGFR binding MRD
LSDNCYWTTWGRECFLPP

SEQ ID NO: 2449 - protein, 18 aa, Artificial Sequence
  EGFR binding MRD
FTDPCYWTTWGRECFLLP

SEQ ID NO: 2450 - protein, 18 aa, Artificial Sequence
  EGFR binding MRD
YNDPCYWTTWGRECLLLP

SEQ ID NO: 2451 - protein, 18 aa, Artificial Sequence
  EGFR binding MRD
SSDPCYWTTWGRECFLLP

SEQ ID NO: 2452 - protein, 19 aa, Artificial Sequence
  EGFR binding MRD
FGDPCYWTTWGRECYLLRP

SEQ ID NO: 2453 - protein, 18 aa, Artificial Sequence
  EGFR binding MRD
LTDPCWWTTWGRECLLLP

SEQ ID NO: 2454 - protein, 18 aa, Artificial Sequence
  EGFR binding MRD
SSDPCYWTTWGRECLLLP

SEQ ID NO: 2455 - protein, 18 aa, Artificial Sequence
  EGFR binding MRD
LSDPCYWTTWGRECLLLP

SEQ ID NO: 2456 - protein, 18 aa, Artificial Sequence
  EGFR binding MRD
FRDPCYWTTWGRECFLPP

SEQ ID NO: 2457 - protein, 19 aa, Artificial Sequence
  EGFR binding MRD
FDDYCCYWATWGRECYLIP

SEQ ID NO: 2458 - protein, 18 aa, Artificial Sequence
  EGFR binding MRD
YSGPCYWTTWGRECILHP

SEQ ID NO: 2459 - protein, 18 aa, Artificial Sequence
  EGFR binding MRD
SSDACYWTTWGRECFLLP

SEQ ID NO: 2460 - protein, 18 aa, Artificial Sequence
  EGFR binding MRD
FSDHCWWSTWGRECYLLP

SEQ ID NO: 2461 - protein, 18 aa, Artificial Sequence
  EGFR binding MRD
TSDPCYWTTWGRECLLNR

SEQ ID NO: 2462 - protein, 18 aa, Artificial Sequence
  EGFR binding MRD
TSDPCYWTTWGRECLLLP

SEQ ID NO: 2463 - protein, 19 aa, Artificial Sequence
  EGFR binding MRD
CSGPCYWTTWGRECCFSLP

SEQ ID NO: 2464 - protein, 18 aa, Artificial Sequence
  EGFR binding MRD
SIDSCFWTTWGRECFLLP

SEQ ID NO: 2465 - protein, 18 aa, Artificial Sequence
  EGFR binding MRD
FSDPCYWTTWGRECFLVQ

SEQ ID NO: 2466 - protein, 18 aa, Artificial Sequence
  EGFR binding MRD
FSDPCYWTTWGRECFLTP

SEQ ID NO: 2467 - protein, 18 aa, Artificial Sequence
  EGFR binding MRD
CRDPCYWTTWGRECYLIP

SEQ ID NO: 2468 - protein, 18 aa, Artificial Sequence
  EGFR binding MRD
FGDPCYWATWGRECFLIP

SEQ ID NO: 2469 - protein, 18 aa, Artificial Sequence
  EGFR binding MRD
FADPCYWTTWGRECLLHP

SEQ ID NO: 2470 - protein, 18 aa, Artificial Sequence
  EGFR binding MRD
FSEPCYWTIWGRECYLLP

SEQ ID NO: 2471 - protein, 18 aa, Artificial Sequence
  EGFR binding MRD
DDDDCYWTTWGRECFLLP

SEQ ID NO: 2472 - protein, 18 aa, Artificial Sequence
  EGFR binding MRD
FSDPCTWTTWGRECFLFS

SEQ ID NO: 2473 - protein, 18 aa, Artificial Sequence
  EGFR binding MRD
FGDPCSWTIWGRECFLLP

SEQ ID NO: 2474 - protein, 18 aa, Artificial Sequence
  EGFR binding MRD
SKDPCYWTTWGRECFLLP

SEQ ID NO: 2475 - protein, 19 aa, Artificial Sequence
  EGFR binding MRD
CTGPCYWTTWGRECCFFVP

SEQ ID NO: 2476 - protein, 18 aa, Artificial Sequence
  EGFR binding MRD
FSDPCYWTTWGRECYLRP

SEQ ID NO: 2477 - protein, 18 aa, Artificial Sequence
  EGFR binding MRD
YSDPCYWTTWGRECFLMP

SEQ ID NO: 2478 - protein, 18 aa, Artificial Sequence
  EGFR binding MRD
FGDPCYWTTWGRECFLLP

SEQ ID NO: 2479 - protein, 18 aa, Artificial Sequence
  EGFR binding MRD
LTDPCYWTTWGRECFLLP

SEQ ID NO: 2480 - protein, 18 aa, Artificial Sequence
  EGFR binding MRD
YIDTCYWTTWGRECFLLP

SEQ ID NO: 2481 - protein, 18 aa, Artificial Sequence
  EGFR binding MRD
FSDPCFWTTWGRECFWVH

SEQ ID NO: 2482 - protein, 17 aa, Artificial Sequence
  EGFR binding MRD
FSDHATGQHGVESAFCF

SEQ ID NO: 2483 - protein, 18 aa, Artificial Sequence
  EGFR binding MRD
FNDPCIWTIWGRECFLLP

SEQ ID NO: 2484 - protein, 18 aa, Artificial Sequence
  EGFR binding MRD
VSDPCYWTIWGRECFLLP

SEQ ID NO: 2485 - protein, 18 aa, Artificial Sequence
  EGFR binding MRD
ISDPCYWTTWGRECFLLP

SEQ ID NO: 2486 - protein, 18 aa, Artificial Sequence
  EGFR binding MRD
FSDPCYWTTWGRECFWVP

SEQ ID NO: 2487 - protein, 18 aa, Artificial Sequence
  EGFR binding MRD
SRDPCHWTTWGRECLLLP

SEQ ID NO: 2488 - protein, 18 aa, Artificial Sequence
  EGFR binding MRD
FSEPCYWTIWGRECFLLP

SEQ ID NO: 2489 - protein, 19 aa, Artificial Sequence
  EGFR binding MRD
VIDTCYWTTWGRECYLLPP

SEQ ID NO: 2490 - protein, 18 aa, Artificial Sequence
  EGFR binding MRD
ITDPCYWTTWGRECFLRP

SEQ ID NO: 2491 - protein, 18 aa, Artificial Sequence
  EGFR binding MRD
PSDPCHWTTWGRECFLQS

SEQ ID NO: 2492 - protein, 18 aa, Artificial Sequence
  EGFR binding MRD
FTDPCYWTIWGRECYLDP

SEQ ID NO: 2493 - protein, 18 aa, Artificial Sequence
  EGFR binding MRD
FSDHCWWTTWGRECLLLP

SEQ ID NO: 2494 - protein, 18 aa, Artificial Sequence
  EGFR binding MRD
FSDPCIWTTWGRECFWVP

SEQ ID NO: 2495 - protein, 19 aa, Artificial Sequence
  EGFR binding MRD
FDDHCCYWTTWGRECFRLP

SEQ ID NO: 2496 - protein, 18 aa, Artificial Sequence
  EGFR binding MRD
FTDPCYWTIWGRECYLDT

SEQ ID NO: 2497 - protein, 18 aa, Artificial Sequence
  EGFR binding MRD
SIDPCYWTTWGRECFFLP

SEQ ID NO: 2498 - protein, 18 aa, Artificial Sequence
  EGFR binding MRD
FADPCYWTIWGRECFLLP

SEQ ID NO: 2499 - protein, 18 aa, Artificial Sequence
  EGFR binding MRD
FSDPCYWTTWGKECFLLH

SEQ ID NO: 2500 - protein, 18 aa, Artificial Sequence
  EGFR binding MRD
AFWQCVYTPMHAMCFSHK

SEQ ID NO: 2501 - protein, 16 aa, Artificial Sequence
  EGFR binding MRD
MTIHWCQPWGCLLLFG

SEQ ID NO: 2502 - protein, 19 aa, Artificial Sequence
  EGFR binding MRD
LYLSCMTGWWGEIVCVSAS

SEQ ID NO: 2503 - protein, 18 aa, Artificial Sequence
  EGFR binding MRD
KGLDCVHWPGMHWCWRSD

SEQ ID NO: 2504 - protein, 18 aa, Artificial Sequence
  EGFR binding MRD
FSDPCYWTIWGRECFLFP

SEQ ID NO: 2505 - protein, 18 aa, Artificial Sequence
  EGFR binding MRD
FLDPCFWTIWGRECYLLP

SEQ ID NO: 2506 - protein, 18 aa, Artificial Sequence
  EGFR binding MRD
FTDPCHWTTWGRECIWLP

SEQ ID NO: 2507 - protein, 18 aa, Artificial Sequence
  EGFR binding MRD
WRAYCHHSPWDFECFQVW

SEQ ID NO: 2508 - protein, 18 aa, Artificial Sequence
  EGFR binding MRD
VGDPCSWTTWGRECFLFD

SEQ ID NO: 2509 - protein, 18 aa, Artificial Sequence
  EGFR binding MRD
FSDPCVWTTWGRECLLLP

SEQ ID NO: 2510 - protein, 15 aa, Artificial Sequence
  EGFR binding MRD
WSPRCFAWIVCLDLS

SEQ ID NO: 2511 - protein, 18 aa, Artificial Sequence
  EGFR binding MRD
YKWVCMWTPFGHQCVSAA

SEQ ID NO: 2512 - protein, 18 aa, Artificial Sequence
  EGFR binding MRD
LGDPCYWTTWGRECVLLP

SEQ ID NO: 2513 - protein, 18 aa, Artificial Sequence
  EGFR binding MRD
KKVFCYYLPFQQYCVTVS

SEQ ID NO: 2514 - protein, 18 aa, Artificial Sequence
  EGFR binding MRD
FVTWCYAWPDSSACYGLH

SEQ ID NO: 2515 - protein, 18 aa, Artificial Sequence
  EGFR binding MRD
FSDPCYWTTWGRECFMPP

SEQ ID NO: 2516 - protein, 18 aa, Artificial Sequence
  EGFR binding MRD
YSDPCYWTTWGRECLLLP

SEQ ID NO: 2517 - protein, 17 aa, Artificial Sequence
  EGFR binding MRD
WFVTCSFQFEWECVQLH

SEQ ID NO: 2518 - protein, 19 aa, Artificial Sequence
  EGFR binding MRD
PDSWCHTLYWQLLHCEMSE

SEQ ID NO: 2519 - protein, 19 aa, Artificial Sequence
  EGFR binding MRD
VDSWCHTLYWQLHYCASQE

SEQ ID NO: 2520 - protein, 19 aa, Artificial Sequence
  EGFR binding MRD
ADSWCHTLYWSLLHCASSE

SEQ ID NO: 2521 - protein, 19 aa, Artificial Sequence
  EGFR binding MRD
PDSGCHTLYWNLQHCASLE

SEQ ID NO: 2522 - protein, 19 aa, Artificial Sequence
  EGFR binding MRD
ADSWCHTLYWQLYYCESLE

SEQ ID NO: 2523 - protein, 19 aa, Artificial Sequence
  EGFR binding MRD
PESWCHTLYWSLQDCVSSE

SEQ ID NO: 2524 - protein, 19 aa, Artificial Sequence
  EGFR binding MRD
PDSWCHTLYWQLHHCLSSE

SEQ ID NO: 2525 - protein, 19 aa, Artificial Sequence
  EGFR binding MRD
ADSWCHTLYWQLLHCVTQE

SEQ ID NO: 2526 - protein, 19 aa, Artificial Sequence
  EGFR binding MRD
ADSWCHTLYWSLLECESRE

SEQ ID NO: 2527 - protein, 19 aa, Artificial Sequence
  EGFR binding MRD
PDSWCHTLFWDLQHCVSGE

SEQ ID NO: 2528 - protein, 19 aa, Artificial Sequence
  EGFR binding MRD
PDSLCHTLYWSLRHCEIEE

SEQ ID NO: 2529 - protein, 19 aa, Artificial Sequence
  EGFR binding MRD
PDSLCHTLYWQLQHCAFWE

SEQ ID NO: 2530 - protein, 19 aa, Artificial Sequence
  EGFR binding MRD
ADSWCHTLYWQLYYCEVWE

SEQ ID NO: 2531 - protein, 19 aa, Artificial Sequence
  EGFR binding MRD
AESWCHTLYWSLHHCVYSE

SEQ ID NO: 2532 - protein, 19 aa, Artificial Sequence
  EGFR binding MRD
TDSWCHTLYWNLLHCASYE

SEQ ID NO: 2533 - protein, 19 aa, Artificial Sequence
  EGFR binding MRD
PDSWCHTLYWQLLHCATLE

SEQ ID NO: 2534 - protein, 19 aa, Artificial Sequence
  EGFR binding MRD
PDSWCHTLYWLLHECESRE

SEQ ID NO: 2535 - protein, 19 aa, Artificial Sequence
  EGFR binding MRD
PDSWCHTLYWSLQFCESSE

SEQ ID NO: 2536 - protein, 19 aa, Artificial Sequence
  EGFR binding MRD
PDSWCHTLYWQLHHCEILE

SEQ ID NO: 2537 - protein, 19 aa, Artificial Sequence
  EGFR binding MRD
PDSWCHTLYWKLHHCLSME

SEQ ID NO: 2538 - protein, 19 aa, Artificial Sequence
  EGFR binding MRD
VDSWCHTLYWQLLHCAMSE

SEQ ID NO: 2539 - protein, 19 aa, Artificial Sequence
  EGFR binding MRD
AESWCHTLYWQLVHCTSLE

SEQ ID NO: 2540 - protein, 19 aa, Artificial Sequence
  EGFR binding MRD
PDSWCHTLYWDLLHCESSE

SEQ ID NO: 2541 - protein, 19 aa, Artificial Sequence
  EGFR binding MRD
ADSWCHTLWWQLHHCLFEE

SEQ ID NO: 2542 - protein, 19 aa, Artificial Sequence
  EGFR binding MRD
TDSWCHTLYWLLHDCTSRE

SEQ ID NO: 2543 - protein, 19 aa, Artificial Sequence
  EGFR binding MRD
ADSWCHTLYWQLLHCVAQE

SEQ ID NO: 2544 - protein, 19 aa, Artificial Sequence
  EGFR binding MRD
PDSSCHTLYWLLEHCLSVE

SEQ ID NO: 2545 - protein, 19 aa, Artificial Sequence
  EGFR binding MRD
PDSWCHTLYWQLHYCTILE

SEQ ID NO: 2546 - protein, 19 aa, Artificial Sequence
  EGFR binding MRD
PDSWCHTLYWQLLHCEISE

SEQ ID NO: 2547 - protein, 19 aa, Artificial Sequence
  EGFR binding MRD
PDSWCHTLYWQLLHCAASE

SEQ ID NO: 2548 - protein, 19 aa, Artificial Sequence
  EGFR binding MRD
PDSWCHTLYWQLHHCVSWE

SEQ ID NO: 2549 - protein, 19 aa, Artificial Sequence
  EGFR binding MRD
TDSWCHTLYWALQHCVSTE

SEQ ID NO: 2550 - protein, 19 aa, Artificial Sequence
  EGFR binding MRD
PDSWCHTLYWQLLHCTTQE

SEQ ID NO: 2551 - protein, 19 aa, Artificial Sequence
  EGFR binding MRD
ADSWCHTLYWQLLHCISLE

SEQ ID NO: 2552 - protein, 19 aa, Artificial Sequence
  EGFR binding MRD
ADSWCHTLYWQLQHCLSQE

SEQ ID NO: 2553 - protein, 19 aa, Artificial Sequence
  EGFR binding MRD
PDSYCHTLYWSLIHCARSE

SEQ ID NO: 2554 - protein, 19 aa, Artificial Sequence
  EGFR binding MRD
TDSWCHTLYWELQYCLMQE

SEQ ID NO: 2555 - protein, 19 aa, Artificial Sequence
  EGFR binding MRD
TDSWCHTLYWQLHHCAILE

SEQ ID NO: 2556 - protein, 19 aa, Artificial Sequence
  EGFR binding MRD
PDSWCHTLYWQLYHCVSLE

SEQ ID NO: 2557 - protein, 19 aa, Artificial Sequence
  EGFR binding MRD
ADSWCHTLYWQLLHCVNQE

SEQ ID NO: 2558 - protein, 19 aa, Artificial Sequence
  EGFR binding MRD
PDSWCHTLYWSLLHCARQE

SEQ ID NO: 2559 - protein, 19 aa, Artificial Sequence
  EGFR binding MRD
ADSWCHTLYWALQHCARSE

SEQ ID NO: 2560 - protein, 19 aa, Artificial Sequence
  EGFR binding MRD
ADSWCHTLYWSLLHCASED

SEQ ID NO: 2561 - protein, 19 aa, Artificial Sequence
  EGFR binding MRD
ADSWCHTLYWDLLHCANLE

SEQ ID NO: 2562 - protein, 19 aa, Artificial Sequence
  EGFR binding MRD
ADSWCHTLYWQLLHCESSE

SEQ ID NO: 2563 - protein, 19 aa, Artificial Sequence
  EGFR binding MRD
PDSWCHTLYWDLLHCPAGE

SEQ ID NO: 2564 - protein, 19 aa, Artificial Sequence
  EGFR binding MRD
ADSWCHTLYWQLHHCTSLE

SEQ ID NO: 2565 - protein, 19 aa, Artificial Sequence
  EGFR binding MRD
ADSWCHTLYWSLQHCASSE

SEQ ID NO: 2566 - protein, 19 aa, Artificial Sequence
  EGFR binding MRD
PDSWCHTLYWQLYHCEMSE

SEQ ID NO: 2567 - protein, 19 aa, Artificial Sequence
  EGFR binding MRD
PDSWCHTLYWDLMHCHHEE

SEQ ID NO: 2568 - protein, 19 aa, Artificial Sequence
  EGFR binding MRD
PDSWCHTLYWQLYYCATSE

SEQ ID NO: 2569 - protein, 19 aa, Artificial Sequence
  EGFR binding MRD
ADSWCHTLYWQLLHCASGE

SEQ ID NO: 2570 - protein, 19 aa, Artificial Sequence
  EGFR binding MRD
ADSWCHTLYWQLYHCAYWE

SEQ ID NO: 2571 - protein, 19 aa, Artificial Sequence
  EGFR binding MRD
TDSWCHTLYWSLAHCAFLE

SEQ ID NO: 2572 - protein, 19 aa, Artificial Sequence
  EGFR binding MRD
ADSWCHTLYWQLLHCETLE

SEQ ID NO: 2573 - protein, 19 aa, Artificial Sequence
  EGFR binding MRD
ADSWCHTLYWQLHHCVSLE

SEQ ID NO: 2574 - protein, 19 aa, Artificial Sequence
  EGFR binding MRD
ADSWCHTLYWDLLHCESLE

SEQ ID NO: 2575 - protein, 19 aa, Artificial Sequence
  EGFR binding MRD
ADSWCHTLYWQLLHCEFSE

SEQ ID NO: 2576 - protein, 19 aa, Artificial Sequence
  EGFR binding MRD
TDSWCHTLYWNLVHCASQD

SEQ ID NO: 2577 - protein, 19 aa, Artificial Sequence
  EGFR binding MRD
PDSWCHTLYWDLLYCVNQE

SEQ ID NO: 2578 - protein, 19 aa, Artificial Sequence
  EGFR binding MRD
PDSWCHTLYWNLHHCLSME

SEQ ID NO: 2579 - protein, 19 aa, Artificial Sequence
  EGFR binding MRD
ADSWCHTLYWALHHCSIQE

SEQ ID NO: 2580 - protein, 19 aa, Artificial Sequence
  EGFR binding MRD
TDSWCHTLYWALQHCVAQE

SEQ ID NO: 2581 - protein, 19 aa, Artificial Sequence
  EGFR binding MRD
PDSRCHTLYWALRYCAYQE

SEQ ID NO: 2582 - protein, 19 aa, Artificial Sequence
  EGFR binding MRD
ADSWCHTLYWNLLYCAIRE

SEQ ID NO: 2583 - protein, 19 aa, Artificial Sequence
  EGFR binding MRD
VDSFCHTLYWQLIHCPIEE

SEQ ID NO: 2584 - protein, 19 aa, Artificial Sequence
  EGFR binding MRD
ADSWCHTLYWNLLHCRALE

SEQ ID NO: 2585 - protein, 19 aa, Artificial Sequence
  EGFR binding MRD
PDSWCHTLYWQLLDCATRE

SEQ ID NO: 2586 - protein, 19 aa, Artificial Sequence
  EGFR binding MRD
ADSWCHTLYWNLRHCEIQE

SEQ ID NO: 2587 - protein, 19 aa, Artificial Sequence
  EGFR binding MRD
PNSWCHTLYWDLLHCVSRE

SEQ ID NO: 2588 - protein, 19 aa, Artificial Sequence
  EGFR binding MRD
ADSWCHTLYWQLHHCAISE

SEQ ID NO: 2589 - protein, 19 aa, Artificial Sequence
  EGFR binding MRD
ADSWCHTLYWSLLHCESFD

SEQ ID NO: 2590 - protein, 19 aa, Artificial Sequence
  EGFR binding MRD
ADSWCHTLYWQLQHCVSWE

SEQ ID NO: 2591 - protein, 19 aa, Artificial Sequence
  EGFR binding MRD
ADSWCHTLYWQLQHCISYE

SEQ ID NO: 2592 - protein, 19 aa, Artificial Sequence
  EGFR binding MRD
PDSWCHTLYWSLQHCAIYE

SEQ ID NO: 2593 - protein, 19 aa, Artificial Sequence
  EGFR binding MRD
PDSWCHTLYWQLLDCTSSE

SEQ ID NO: 2594 - protein, 19 aa, Artificial Sequence
  EGFR binding MRD
PDSWCHTLYWHLQHCLSQE

SEQ ID NO: 2595 - protein, 19 aa, Artificial Sequence
  EGFR binding MRD
AESWCHTLYWSLYHCASEE

SEQ ID NO: 2596 - protein, 19 aa, Artificial Sequence
  EGFR binding MRD
PDSWCHTLYWQLQHCVSWE

SEQ ID NO: 2597 - protein, 19 aa, Artificial Sequence
  EGFR binding MRD
ADSWCHTLYWQLLHCVSQE

SEQ ID NO: 2598 - protein, 19 aa, Artificial Sequence
  EGFR binding MRD
ADSWCHTLYWQLQYCVMQE

SEQ ID NO: 2599 - protein, 19 aa, Artificial Sequence
  EGFR binding MRD
ADSWCHTLYWQLLHCESLE

SEQ ID NO: 2600 - protein, 19 aa, Artificial Sequence
  EGFR binding MRD
ADSWCHTLYWQLHHCVLEE

SEQ ID NO: 2601 - protein, 19 aa, Artificial Sequence
  EGFR binding MRD
PDSWCHTLYWSLHHCLISE

SEQ ID NO: 2602 - protein, 19 aa, Artificial Sequence
  EGFR binding MRD
PDSWCHTLYWQLIHCERQE

SEQ ID NO: 2603 - protein, 19 aa, Artificial Sequence
  EGFR binding MRD
PDSWCHTLYWNLQHCERME

SEQ ID NO: 2604 - protein, 19 aa, Artificial Sequence
  EGFR binding MRD
ADSWCHTLYWQLKHCEFTE

SEQ ID NO: 2605 - protein, 19 aa, Artificial Sequence
  EGFR binding MRD
ADSWCHTLYWNLLYCANQE

SEQ ID NO: 2606 - protein, 19 aa, Artificial Sequence
  EGFR binding MRD
PDSWCHTLYWSLQHCLNME

SEQ ID NO: 2607 - protein, 19 aa, Artificial Sequence
  EGFR binding MRD
PDSWCHTLYWSLYHCTISD

SEQ ID NO: 2608 - protein, 19 aa, Artificial Sequence
  EGFR binding MRD
ADSWCHTLWWQLLHCESGE

SEQ ID NO: 2609 - protein, 19 aa, Artificial Sequence
  EGFR binding MRD
SDSWCHTLYWSLRHCESLE

SEQ ID NO: 2610 - protein, 19 aa, Artificial Sequence
  EGFR binding MRD
ADSWCHTLYWDLQHCLRWE

SEQ ID NO: 2611 - protein, 19 aa, Artificial Sequence
  EGFR binding MRD
PDSWCHTLYWQLLYCESWE

SEQ ID NO: 2612 - protein, 19 aa, Artificial Sequence
  EGFR binding MRD
ANSWCHTLFWDLHHCLSLE

SEQ ID NO: 2613 - protein, 19 aa, Artificial Sequence
  EGFR binding MRD
ADSWCHTLYWQLYHCTSLE

SEQ ID NO: 2614 - protein, 19 aa, Artificial Sequence
  EGFR binding MRD
PDSWCHTLYWQLRHCEISE

SEQ ID NO: 2615 - protein, 19 aa, Artificial Sequence
  EGFR binding MRD
PDSGCHTLYWSLQHCTFWE

SEQ ID NO: 2616 - protein, 19 aa, Artificial Sequence
  EGFR binding MRD
ADSWCHTLYWQLYHCEVLE

SEQ ID NO: 2617 - protein, 19 aa, Artificial Sequence
  EGFR binding MRD
PDSWCHTLYWDLHWCVSLE

SEQ ID NO: 2618 - protein, 19 aa, Artificial Sequence
  EGFR binding MRD
ADSWCHTLYWSLLHCAIGE

SEQ ID NO: 2619 - protein, 19 aa, Artificial Sequence
  EGFR binding MRD
ADSWCHTLYWQLHHCLWLE

SEQ ID NO: 2620 - protein, 19 aa, Artificial Sequence
  EGFR binding MRD
ADSWCHTLYWSLAHCLSGE

SEQ ID NO: 2621 - protein, 19 aa, Artificial Sequence
  EGFR binding MRD
AESWCHTLYWDLHYCVYHE

SEQ ID NO: 2622 - protein, 19 aa, Artificial Sequence
  EGFR binding MRD
SDSWCHTLYWSLQHCVISE

SEQ ID NO: 2623 - protein, 19 aa, Artificial Sequence
  EGFR binding MRD
ADSWCHTLYWNLLHCEYRE

SEQ ID NO: 2624 - protein, 19 aa, Artificial Sequence
  EGFR binding MRD
ADSWCHTLYWQLLHCASEE

SEQ ID NO: 2625 - protein, 19 aa, Artificial Sequence
  EGFR binding MRD
PESWCHTLYWQMIFCESFE

SEQ ID NO: 2626 - protein, 19 aa, Artificial Sequence
  EGFR binding MRD
ANSWCHTLYWQLHHCEILE

SEQ ID NO: 2627 - protein, 19 aa, Artificial Sequence
  EGFR binding MRD
PDSWCHTLYWALHHCASSE

SEQ ID NO: 2628 - protein, 19 aa, Artificial Sequence
  EGFR binding MRD
PDSSCHTLYWQLHHCARRE

SEQ ID NO: 2629 - protein, 19 aa, Artificial Sequence
  EGFR binding MRD
ADSWCHTLYWDLQHCLILE

SEQ ID NO: 2630 - protein, 19 aa, Artificial Sequence
  EGFR binding MRD
ADSWCHTLFWNLKHCLIQE

SEQ ID NO: 2631 - protein, 19 aa, Artificial Sequence
  EGFR binding MRD
ANSWCHTLYWDLMYCVWQE

SEQ ID NO: 2632 - protein, 19 aa, Artificial Sequence
  EGFR binding MRD
ADSWCHTLYWQLHHCVTLE

SEQ ID NO: 2633 - protein, 19 aa, Artificial Sequence
  EGFR binding MRD
PDSWCHTLYWALHHCVSSE

SEQ ID NO: 2634 - protein, 49 aa, Artificial Sequence
  EGFR binding MRD
GGSGCHGYLWQLLHCETWEGQAGQAAAGGSTDSWCHTLYWQLYHCASSE

SEQ ID NO: 2635 - protein, 19 aa, Artificial Sequence
  EGFR binding MRD
PESWCHTLYWNLQHCLSGE

SEQ ID NO: 2636 - protein, 19 aa, Artificial Sequence
  EGFR binding MRD
PDSWCHTLYWQLIHCESLE

SEQ ID NO: 2637 - protein, 19 aa, Artificial Sequence
  EGFR binding MRD
PDSWCHTLYWVLLDCARHE

SEQ ID NO: 2638 - protein, 19 aa, Artificial Sequence
  EGFR binding MRD
PDSWCHTMYWSLIHCMNME

SEQ ID NO: 2639 - protein, 19 aa, Artificial Sequence
  EGFR binding MRD
AASWCQALYWHQFCCASWE

SEQ ID NO: 2640 - protein, 19 aa, Artificial Sequence
  EGFR binding MRD
ADSWCHTLFWQLQHCVWQE

SEQ ID NO: 2641 - protein, 19 aa, Artificial Sequence
  EGFR binding MRD
TDSWCHTLYWSLLHCESLG

SEQ ID NO: 2642 - protein, 19 aa, Artificial Sequence
  EGFR binding MRD
PDSWCHTLYWQLYHCLSLE

SEQ ID NO: 2643 - protein, 18 aa, Artificial Sequence
  EGFR binding MRD
SPDSCWWAIWGKECILLP

SEQ ID NO: 2644 - protein, 18 aa, Artificial Sequence
  EGFR binding MRD
LSSGCYWAVWGRECLLIP

SEQ ID NO: 2645 - protein, 18 aa, Artificial Sequence
  EGFR binding MRD
LADGCWWAAWGRECLLPP

SEQ ID NO: 2646 - protein, 18 aa, Artificial Sequence
  EGFR binding MRD
LPGGCWWSAWGRECILLP

SEQ ID NO: 2647 - protein, 18 aa, Artificial Sequence
  EGFR binding MRD
LPEGCWWAVWGRECQLQP

SEQ ID NO: 2648 - protein, 18 aa, Artificial Sequence
  EGFR binding MRD
LPEGCWWSTWGRECLLLP

SEQ ID NO: 2649 - protein, 18 aa, Artificial Sequence
  EGFR binding MRD
LPEGCYWAIWGKECFLPP

SEQ ID NO: 2650 - protein, 18 aa, Artificial Sequence
  EGFR binding MRD
LPDGCWWAQWGRECLLLP

SEQ ID NO: 2651 - protein, 18 aa, Artificial Sequence
  EGFR binding MRD
DPDGCHWEVWGRECILLP

SEQ ID NO: 2652 - protein, 18 aa, Artificial Sequence
  EGFR binding MRD
LPEGCWWATWGRECLLPP

SEQ ID NO: 2653 - protein, 18 aa, Artificial Sequence
  EGFR binding MRD
LPDGCWWSLWGRECFLPP

SEQ ID NO: 2654 - protein, 18 aa, Artificial Sequence
  EGFR binding MRD
LLDVCWWSTWGRECLLQP

SEQ ID NO: 2655 - protein, 18 aa, Artificial Sequence
  EGFR binding MRD
LPEGCWWAHWGRECVMVP

SEQ ID NO: 2656 - protein, 18 aa, Artificial Sequence
  EGFR binding MRD
LPDDCYWAQWGRECHMLP

SEQ ID NO: 2657 - protein, 18 aa, Artificial Sequence
  EGFR binding MRD
LPEGCYWAVWGRECILPR

SEQ ID NO: 2658 - protein, 18 aa, Artificial Sequence
  EGFR binding MRD
VPEGCWWSPWGRECLLPP

SEQ ID NO: 2659 - protein, 18 aa, Artificial Sequence
  EGFR binding MRD
LPSGCWWAVWGKECLLLP

SEQ ID NO: 2660 - protein, 18 aa, Artificial Sequence
  EGFR binding MRD
MPEGCWWSLWGRECMLLP

SEQ ID NO: 2661 - protein, 18 aa, Artificial Sequence
  EGFR binding MRD
LPEGCWWATWGKECLLLP

SEQ ID NO: 2662 - protein, 18 aa, Artificial Sequence
  EGFR binding MRD
LPEGCYWAIWGKECYLQA

SEQ ID NO: 2663 - protein, 18 aa, Artificial Sequence
  EGFR binding MRD
LPEGCWWATWGRECFLLP

SEQ ID NO: 2664 - protein, 18 aa, Artificial Sequence
  EGFR binding MRD
PPDGCWWAVWGRECLLLP

SEQ ID NO: 2665 - protein, 18 aa, Artificial Sequence
  EGFR binding MRD
LPESCWWSPWGRECLLPP

SEQ ID NO: 2666 - protein, 18 aa, Artificial Sequence
  EGFR binding MRD
LSEGCWWAVWGKECILPP

SEQ ID NO: 2667 - protein, 18 aa, Artificial Sequence
  EGFR binding MRD
LSEGCWWAVWGRECLLQP

SEQ ID NO: 2668 - protein, 18 aa, Artificial Sequence
  EGFR binding MRD
LPVGCWWSVWGRECLLPP

SEQ ID NO: 2669 - protein, 18 aa, Artificial Sequence
  EGFR binding MRD
VPAGCWWAPWGRECILSP

SEQ ID NO: 2670 - protein, 18 aa, Artificial Sequence
  EGFR binding MRD
LPSACNWSPWSWQCFWLP

SEQ ID NO: 2671 - protein, 18 aa, Artificial Sequence
  EGFR binding MRD
LPEGCWWAVWGKECVLSP

SEQ ID NO: 2672 - protein, 18 aa, Artificial Sequence
  EGFR binding MRD
LPEGCWWSSWGKECFLHP

SEQ ID NO: 2673 - protein, 18 aa, Artificial Sequence
  EGFR binding MRD
LPDGCWWSPWGRECILLP

SEQ ID NO: 2674 - protein, 18 aa, Artificial Sequence
  EGFR binding MRD
LPDGCWWAVWGRECILPP

SEQ ID NO: 2675 - protein, 18 aa, Artificial Sequence
  EGFR binding MRD
LPEGCWWATWGKECVLLP

SEQ ID NO: 2676 - protein, 18 aa, Artificial Sequence
  EGFR binding MRD
LPDGCWWSAWGKECFLLP

SEQ ID NO: 2677 - protein, 18 aa, Artificial Sequence
  EGFR binding MRD
LPEGCWWSVWGKECLLLP

SEQ ID NO: 2678 - protein, 18 aa, Artificial Sequence
  EGFR binding MRD
LPEGCWWAHWGRECLLQP

SEQ ID NO: 2679 - protein, 18 aa, Artificial Sequence
  EGFR binding MRD
FPERCWWAMWGKECYLLP

SEQ ID NO: 2680 - protein, 18 aa, Artificial Sequence
  EGFR binding MRD
LPEGCWWTVWGKECYLLP

SEQ ID NO: 2681 - protein, 18 aa, Artificial Sequence
  EGFR binding MRD
LSADCWWSPWGRECILKP

SEQ ID NO: 2682 - protein, 18 aa, Artificial Sequence
  EGFR binding MRD
PSQGCWWSVWGRECFLPP

SEQ ID NO: 2683 - protein, 18 aa, Artificial Sequence
  EGFR binding MRD
FPEECWWATWGRECFLPR

SEQ ID NO: 2684 - protein, 18 aa, Artificial Sequence
  EGFR binding MRD
FPEGCWWATWGKECLLRP

SEQ ID NO: 2685 - protein, 18 aa, Artificial Sequence
  EGFR binding MRD
LPDGCWWALWGKECFLMH

SEQ ID NO: 2686 - protein, 18 aa, Artificial Sequence
  EGFR binding MRD
LPEGCYWAQWGKECFLVP

SEQ ID NO: 2687 - protein, 18 aa, Artificial Sequence
  EGFR binding MRD
LADSCYWTIWGRECLLPP

SEQ ID NO: 2688 - protein, 18 aa, Artificial Sequence
  EGFR binding MRD
FPADCWWSTWGRECFLQP

SEQ ID NO: 2689 - protein, 18 aa, Artificial Sequence
  EGFR binding MRD
LPEGCYWAVWGRECYLVP

SEQ ID NO: 2690 - protein, 18 aa, Artificial Sequence
  EGFR binding MRD
LPEGCWWAVWGRECLLLP

SEQ ID NO: 2691 - protein, 18 aa, Artificial Sequence
  EGFR binding MRD
DPEGCFWAVWGRECLLQP

SEQ ID NO: 2692 - protein, 18 aa, Artificial Sequence
  EGFR binding MRD
FADGCWWEVWGRECLLLP

SEQ ID NO: 2693 - protein, 18 aa, Artificial Sequence
  EGFR binding MRD
DPEGCWWAVWGRECLLRP

SEQ ID NO: 2694 - protein, 18 aa, Artificial Sequence
  EGFR binding MRD
VSEGCWWAIWGRECILLP

SEQ ID NO: 2695 - protein, 18 aa, Artificial Sequence
  EGFR binding MRD
LPEGCWWSPWGKECLMTP

SEQ ID NO: 2696 - protein, 18 aa, Artificial Sequence
  EGFR binding MRD
LPDGCWWALWGKECILRP

SEQ ID NO: 2697 - protein, 18 aa, Artificial Sequence
  EGFR binding MRD
LPDGCWWSQWGRECILVP

SEQ ID NO: 2698 - protein, 18 aa, Artificial Sequence
  EGFR binding MRD
LPQDCWWAIWGRECFMLP

SEQ ID NO: 2699 - protein, 18 aa, Artificial Sequence
  EGFR binding MRD
LPDVCWWAVWGRECLLMP

SEQ ID NO: 2700 - protein, 18 aa, Artificial Sequence
  EGFR binding MRD
LPEGCWWAKWGKECVLPS

SEQ ID NO: 2701 - protein, 18 aa, Artificial Sequence
  EGFR binding MRD
LPEGCYWTIWGRECFLFP

SEQ ID NO: 2702 - protein, 18 aa, Artificial Sequence
  EGFR binding MRD
LPESCWWAVWGRECLLSP

SEQ ID NO: 2703 - protein, 18 aa, Artificial Sequence
  EGFR binding MRD
SPDGCWWSQWGRECIMLP

SEQ ID NO: 2704 - protein, 18 aa, Artificial Sequence
  EGFR binding MRD
KPESCWWANWGRECLLLP

SEQ ID NO: 2705 - protein, 18 aa, Artificial Sequence
  EGFR binding MRD
LSEGCWWATWGKECLLLP

SEQ ID NO: 2706 - protein, 18 aa, Artificial Sequence
  EGFR binding MRD
VAGGCWWATWGRECLLPP

SEQ ID NO: 2707 - protein, 18 aa, Artificial Sequence
  EGFR binding MRD
SAEGCWWAVWGRECLLLP

SEQ ID NO: 2708 - protein, 18 aa, Artificial Sequence
  EGFR binding MRD
LPEGCYWAIWGRECLLPR

SEQ ID NO: 2709 - protein, 18 aa, Artificial Sequence
  EGFR binding MRD
LPEGCFWAVWGKECFLLP

SEQ ID NO: 2710 - protein, 18 aa, Artificial Sequence
  EGFR binding MRD
LTEGCWWAQWGRECILLP

SEQ ID NO: 2711 - protein, 18 aa, Artificial Sequence
  EGFR binding MRD
LPKGCFWTTWGKECLLLP

SEQ ID NO: 2712 - protein, 18 aa, Artificial Sequence
  EGFR binding MRD
LPEGCWWTVWGRECLLLP

SEQ ID NO: 2713 - protein, 18 aa, Artificial Sequence
  EGFR binding MRD
LPDDCWWAPWGRECFLRP

SEQ ID NO: 2714 - protein, 18 aa, Artificial Sequence
  EGFR binding MRD
DSDGCYWAVWGRECFFLP

SEQ ID NO: 2715 - protein, 18 aa, Artificial Sequence
  EGFR binding MRD
LRDGCWWAIWGRKCLLLP

SEQ ID NO: 2716 - protein, 18 aa, Artificial Sequence
  EGFR binding MRD
VDEGCWWAVWGRECVLPE

SEQ ID NO: 2717 - protein, 18 aa, Artificial Sequence
  EGFR binding MRD
HTDGCWWAQWGRECLLVP

SEQ ID NO: 2718 - protein, 18 aa, Artificial Sequence
  EGFR binding MRD
LPEGCWWAPWGKECLLLP

SEQ ID NO: 2719 - protein, 18 aa, Artificial Sequence
  EGFR binding MRD
LPDGCWWASWGRECFLIP

SEQ ID NO: 2720 - protein, 18 aa, Artificial Sequence
  EGFR binding MRD
LPEGCWWAVWGRECILLS

SEQ ID NO: 2721 - protein, 18 aa, Artificial Sequence
  EGFR binding MRD
LPDACWWSVWGKECILEP

SEQ ID NO: 2722 - protein, 18 aa, Artificial Sequence
  EGFR binding MRD
DPHGCWWSPWGRECVLLD

SEQ ID NO: 2723 - protein, 18 aa, Artificial Sequence
  EGFR binding MRD
LPQGCYWAVWGRECLLPL

SEQ ID NO: 2724 - protein, 18 aa, Artificial Sequence
  EGFR binding MRD
LDAPCYWTVWGKECFLFS

SEQ ID NO: 2725 - protein, 18 aa, Artificial Sequence
  EGFR binding MRD
DHYGCYWTQWGRECFPMY

SEQ ID NO: 2726 - protein, 18 aa, Artificial Sequence
  EGFR binding MRD
LPEGCYWAVWGKECFLLP

SEQ ID NO: 2727 - protein, 18 aa, Artificial Sequence
  EGFR binding MRD
LHEGCWWAVWGKECFLLP

SEQ ID NO: 2728 - protein, 18 aa, Artificial Sequence
  EGFR binding MRD
LPEGCWWSKWGRECILVP

SEQ ID NO: 2729 - protein, 18 aa, Artificial Sequence
  EGFR binding MRD
LPQGCWWANWGRECFLLP

SEQ ID NO: 2730 - protein, 18 aa, Artificial Sequence
  EGFR binding MRD
LPEGCWWATWGRECILLP

SEQ ID NO: 2731 - protein, 18 aa, Artificial Sequence
  EGFR binding MRD
ISDGCWWAIWGRECLLMP

SEQ ID NO: 2732 - protein, 18 aa, Artificial Sequence
  EGFR binding MRD
TPDGCYWAVWGRECFLRP

SEQ ID NO: 2733 - protein, 18 aa, Artificial Sequence
  EGFR binding MRD
LPGDCWWAIWGRECLLPP

SEQ ID NO: 2734 - protein, 18 aa, Artificial Sequence
  EGFR binding MRD
FADGCWWAVWGRECFWEP

SEQ ID NO: 2735 - protein, 18 aa, Artificial Sequence
  EGFR binding MRD
LPEGCWWAVWGKECFMLP

SEQ ID NO: 2736 - protein, 18 aa, Artificial Sequence
  EGFR binding MRD
LPEGCWWSTWGKECVLLP

SEQ ID NO: 2737 - protein, 18 aa, Artificial Sequence
  EGFR binding MRD
LPDGCWWSLWGKECHLLQ

SEQ ID NO: 2738 - protein, 18 aa, Artificial Sequence
  EGFR binding MRD
LPEGCWWAHWGKECQLRP

SEQ ID NO: 2739 - protein, 18 aa, Artificial Sequence
  EGFR binding MRD
DPEGCWWATWGRECLLLP

SEQ ID NO: 2740 - protein, 18 aa, Artificial Sequence
  EGFR binding MRD
LPDGCWWAHWGRECLLPP

SEQ ID NO: 2741 - protein, 18 aa, Artificial Sequence
  EGFR binding MRD
LPDGCWWAKWGKECLLWP

SEQ ID NO: 2742 - protein, 18 aa, Artificial Sequence
  EGFR binding MRD
LPDGCWWSVWGKECILLP

SEQ ID NO: 2743 - protein, 18 aa, Artificial Sequence
  EGFR binding MRD
RSEGCWWATWGRECFLHP

SEQ ID NO: 2744 - protein, 18 aa, Artificial Sequence
  EGFR binding MRD
LPEVCWWATWGHECLLLP

SEQ ID NO: 2745 - protein, 18 aa, Artificial Sequence
  EGFR binding MRD
LPEGCWWSSWGRECFLLP

SEQ ID NO: 2746 - protein, 18 aa, Artificial Sequence
  EGFR binding MRD
LPEGCYWATWGKECLLQP

SEQ ID NO: 2747 - protein, 18 aa, Artificial Sequence
  EGFR binding MRD
LPQGCWWATWGRECLLRP

SEQ ID NO: 2748 - protein, 18 aa, Artificial Sequence
  EGFR binding MRD
LPDGCWWAVWGRECLLLP

SEQ ID NO: 2749 - protein, 18 aa, Artificial Sequence
  EGFR binding MRD
VSEGCWWAIWGRECFLQP

SEQ ID NO: 2750 - protein, 18 aa, Artificial Sequence
  EGFR binding MRD
VADGCVWMVWGRECLLLP

SEQ ID NO: 2751 - protein, 18 aa, Artificial Sequence
  EGFR binding MRD
VPEACWWALWGRECILRP

SEQ ID NO: 2752 - protein, 18 aa, Artificial Sequence
  EGFR binding MRD
LPQGCYWTVWGRECLLVP

SEQ ID NO: 2753 - protein, 18 aa, Artificial Sequence
  EGFR binding MRD
QPEYCWWATWGRECLLVP

SEQ ID NO: 2754 - protein, 18 aa, Artificial Sequence
  EGFR binding MRD
LPEGCFWAIWGSECLLLP

SEQ ID NO: 2755 - protein, 18 aa, Artificial Sequence
  EGFR binding MRD
LPEACWWSTWGRECLLLP

SEQ ID NO: 2756 - protein, 18 aa, Artificial Sequence
  EGFR binding MRD
VPEGCWWAVWGVECQLLP

SEQ ID NO: 2757 - protein, 18 aa, Artificial Sequence
  EGFR binding MRD
LPESCCWTDWGHECFLPP

SEQ ID NO: 2758 - protein, 18 aa, Artificial Sequence
  EGFR binding MRD
FPEDCWWSVWGRECLLLP

SEQ ID NO: 2759 - protein, 18 aa, Artificial Sequence
  EGFR binding MRD
LSGGCWWAVWGRECLLLP

SEQ ID NO: 2760 - protein, 18 aa, Artificial Sequence
  EGFR binding MRD
LPDGCWWSQWGRECILLP

SEQ ID NO: 2761 - protein, 18 aa, Artificial Sequence
  EGFR binding MRD
MPEGCWWAAWGRECILLP

SEQ ID NO: 2762 - protein, 18 aa, Artificial Sequence
  EGFR binding MRD
LPEGCYWAVWGRECLLLP

SEQ ID NO: 2763 - protein, 18 aa, Artificial Sequence
  EGFR binding MRD
LPDGCYWAIWGRECILPN

SEQ ID NO: 2764 - protein, 18 aa, Artificial Sequence
  EGFR binding MRD
LPEGCWWAIWGRECLLLP

SEQ ID NO: 2765 - protein, 18 aa, Artificial Sequence
  EGFR binding MRD
LPEGCWWATWGRECLLLP

SEQ ID NO: 2766 - protein, 18 aa, Artificial Sequence
  EGFR binding MRD
LPEGCYWTTWGKECLLRP

SEQ ID NO: 2767 - protein, 18 aa, Artificial Sequence
  EGFR binding MRD
LPDGCYWAVWGKECYQIR

SEQ ID NO: 2768 - protein, 18 aa, Artificial Sequence
  EGFR binding MRD
LPEGCWWSSWGKECFLLP

SEQ ID NO: 2769 - protein, 18 aa, Artificial Sequence
  EGFR binding MRD
LPEGCWWAHWGKECLLGP

SEQ ID NO: 2770 - protein, 18 aa, Artificial Sequence
  EGFR binding MRD
IPDGCWWTVWGRECFLHP

SEQ ID NO: 2771 - protein, 18 aa, Artificial Sequence
  EGFR binding MRD
LPEGCWWSIWGRECILLP

SEQ ID NO: 2772 - protein, 18 aa, Artificial Sequence
  EGFR binding MRD
LPEGCHWTMWGKECFLPP

SEQ ID NO: 2773 - protein, 18 aa, Artificial Sequence
  EGFR binding MRD
LPEGCWWATWGRECILPP

SEQ ID NO: 2774 - protein, 18 aa, Artificial Sequence
  EGFR binding MRD
LPEGCWWAPWGKECILPH

SEQ ID NO: 2775 - protein, 18 aa, Artificial Sequence
  EGFR binding MRD
LPEGCWWSNWGRECFMRQ

SEQ ID NO: 2776 - protein, 18 aa, Artificial Sequence
  EGFR binding MRD
LPSGCWWAIWGRECLLPP

SEQ ID NO: 2777 - protein, 18 aa, Artificial Sequence
  EGFR binding MRD
LADGCYWAIWGRECLLLP

SEQ ID NO: 2778 - protein, 18 aa, Artificial Sequence
  EGFR binding MRD
LPEGCFWTVWGKECLLLP

SEQ ID NO: 2779 - protein, 18 aa, Artificial Sequence
  EGFR binding MRD
LPEGCYWTTWGRECLLLP

SEQ ID NO: 2780 - protein, 18 aa, Artificial Sequence
  EGFR binding MRD
LPDGCWWSTWGRECVLLP

SEQ ID NO: 2781 - protein, 18 aa, Artificial Sequence
  EGFR binding MRD
MPDNCWWALWGKECFLMP

SEQ ID NO: 2782 - protein, 18 aa, Artificial Sequence
  EGFR binding MRD
LPEGCWWAVWGKECLLLP

SEQ ID NO: 2783 - protein, 18 aa, Artificial Sequence
  EGFR binding MRD
DPYGCWWTQWGRECHLLP

SEQ ID NO: 2784 - protein, 18 aa, Artificial Sequence
  EGFR binding MRD
LPEGCYWALWGKECLLPP

SEQ ID NO: 2785 - protein, 18 aa, Artificial Sequence
  EGFR binding MRD
GPEDCWWSTWGRECYLAP

SEQ ID NO: 2786 - protein, 18 aa, Artificial Sequence
  EGFR binding MRD
LPEGCIWTTWGKECFLQF

SEQ ID NO: 2787 - protein, 18 aa, Artificial Sequence
  EGFR binding MRD
LPAGCWWSAWGRECLLTP

SEQ ID NO: 2788 - protein, 18 aa, Artificial Sequence
  EGFR binding MRD
LNEQCWWAVWGHECLLLP

SEQ ID NO: 2789 - protein, 18 aa, Artificial Sequence
  EGFR binding MRD
IPDDCWWAVWGRECLLLN

SEQ ID NO: 2790 - protein, 18 aa, Artificial Sequence
  EGFR binding MRD
LPEGCWWSQWGRECILPP

SEQ ID NO: 2791 - protein, 18 aa, Artificial Sequence
  EGFR binding MRD
LPEGCFWTIWGQECFLLP

SEQ ID NO: 2792 - protein, 18 aa, Artificial Sequence
  EGFR binding MRD
LPDGCWWSQWGKECILLP

SEQ ID NO: 2793 - protein, 18 aa, Artificial Sequence
  EGFR binding MRD
LPEGCWWSTWGRECILLP

SEQ ID NO: 2794 - protein, 18 aa, Artificial Sequence
  EGFR binding MRD
LPDGCWWSIWGRECLLAP

SEQ ID NO: 2795 - protein, 18 aa, Artificial Sequence
  EGFR binding MRD
VPDGCWWSPWGRECLLPP

SEQ ID NO: 2796 - protein, 18 aa, Artificial Sequence
  EGFR binding MRD
VPESCWWAVWGRECLLLP

SEQ ID NO: 2797 - protein, 18 aa, Artificial Sequence
  EGFR binding MRD
LPDGCWWAMWGRECILEP

SEQ ID NO: 2798 - protein, 18 aa, Artificial Sequence
  EGFR binding MRD
LPEGCYWTIWGKECFLLP

SEQ ID NO: 2799 - protein, 18 aa, Artificial Sequence
  EGFR binding MRD
LPDNCVWMVWGRECLLVS

SEQ ID NO: 2800 - protein, 18 aa, Artificial Sequence
  EGFR binding MRD
LTEGCWWATWGRECFLLP

SEQ ID NO: 2801 - protein, 18 aa, Artificial Sequence
  EGFR binding MRD
LPKGCFWTVWGKDCYLLP

SEQ ID NO: 2802 - protein, 18 aa, Artificial Sequence
  EGFR binding MRD
LPEGCFWAKWGKECYLTQ

SEQ ID NO: 2803 - protein, 18 aa, Artificial Sequence
  EGFR binding MRD
LPDGCWWAVWGRECLMLP

SEQ ID NO: 2804 - protein, 18 aa, Artificial Sequence
  EGFR binding MRD
DSYGCFWTIWGRECLLLP

SEQ ID NO: 2805 - protein, 18 aa, Artificial Sequence
  EGFR binding MRD
LSDGCWWAVWGRECLIQK

SEQ ID NO: 2806 - protein, 18 aa, Artificial Sequence
  EGFR binding MRD
HPEGCWWAVWGKECLLPP

SEQ ID NO: 2807 - protein, 18 aa, Artificial Sequence
  EGFR binding MRD
LPEGCWWAIWGRECLMQP

SEQ ID NO: 2808 - protein, 18 aa, Artificial Sequence
  EGFR binding MRD
SLEGCWWSPWGKECFLPP

SEQ ID NO: 2809 - protein, 18 aa, Artificial Sequence
  EGFR binding MRD
LPSGCWWSTWGRECLLLP

SEQ ID NO: 2810 - protein, 18 aa, Artificial Sequence
  EGFR binding MRD
LPDGCYWAVWGRECLLLP

SEQ ID NO: 2811 - protein, 18 aa, Artificial Sequence
  EGFR binding MRD
LPEACWWATWGRECILLP

SEQ ID NO: 2812 - protein, 18 aa, Artificial Sequence
  EGFR binding MRD
LPEGCCWTVWGLECFLCP

SEQ ID NO: 2813 - protein, 18 aa, Artificial Sequence
  EGFR binding MRD
MPEGCYWAQWGKECLLVP

SEQ ID NO: 2814 - protein, 18 aa, Artificial Sequence
  EGFR binding MRD
LPEGCLWMVWGKECFLVP

SEQ ID NO: 2815 - protein, 18 aa, Artificial Sequence
  EGFR binding MRD
LPEGCHWAVWGKECQLQP

SEQ ID NO: 2816 - protein, 18 aa, Artificial Sequence
  EGFR binding MRD
LPEGCWWAPWGRECILPP

SEQ ID NO: 2817 - protein, 18 aa, Artificial Sequence
  EGFR binding MRD
LPEGCHWEIWGKECFLPP

SEQ ID NO: 2818 - protein, 18 aa, Artificial Sequence
  EGFR binding MRD
LPKGCYWATWGRECLLVP

SEQ ID NO: 2819 - protein, 18 aa, Artificial Sequence
  EGFR binding MRD
LPEGCYWAVWGKECLLRP

SEQ ID NO: 2820 - protein, 18 aa, Artificial Sequence
  EGFR binding MRD
IGDACYWTVWGRECLLLP

SEQ ID NO: 2821 - protein, 18 aa, Artificial Sequence
  EGFR binding MRD
LPDGCVWTVWGRECFGFP

SEQ ID NO: 2822 - protein, 18 aa, Artificial Sequence
  EGFR binding MRD
SPDGCYWALWGRECLLAP

SEQ ID NO: 2823 - protein, 18 aa, Artificial Sequence
  EGFR binding MRD
LPQGCWWSVWGKECILRP

SEQ ID NO: 2824 - protein, 18 aa, Artificial Sequence
  EGFR binding MRD
LPKGCWWAVWGKECLMQS

SEQ ID NO: 2825 - protein, 18 aa, Artificial Sequence
  EGFR binding MRD
LPEGCWWAVWGRECLMLH

SEQ ID NO: 2826 - protein, 18 aa, Artificial Sequence
  EGFR binding MRD
LPEGCYWTTWGKECFLLP

SEQ ID NO: 2827 - protein, 18 aa, Artificial Sequence
  EGFR binding MRD
YAEHCSMFPNDWICTLVT

SEQ ID NO: 2828 - protein, 18 aa, Artificial Sequence
  EGFR binding MRD
YAEHCWQFPTDWICTLMP

SEQ ID NO: 2829 - protein, 18 aa, Artificial Sequence
  EGFR binding MRD
YVEHCWQFPTDWICTLKT

SEQ ID NO: 2830 - protein, 18 aa, Artificial Sequence
  EGFR binding MRD
YVDHCWHFPADWICGLST

SEQ ID NO: 2831 - protein, 18 aa, Artificial Sequence
  EGFR binding MRD
YEEHCRLFPADWICSLLQ

SEQ ID NO: 2832 - protein, 18 aa, Artificial Sequence
  EGFR binding MRD
YLEHCRHFPTDWICSLLP

SEQ ID NO: 2833 - protein, 18 aa, Artificial Sequence
  EGFR binding MRD
YLEHCRQFPGDWICTLLE

SEQ ID NO: 2834 - protein, 18 aa, Artificial Sequence
  EGFR binding MRD
YAEHCRMFPTDWICSLIT

SEQ ID NO: 2835 - protein, 18 aa, Artificial Sequence
  EGFR binding MRD
YVEHCCKFPTDWICTLNS

SEQ ID NO: 2836 - protein, 18 aa, Artificial Sequence
  EGFR binding MRD
YAEHCWLFPTDWICGLRA

SEQ ID NO: 2837 - protein, 18 aa, Artificial Sequence
  EGFR binding MRD
YAEHCRLFPTDWICTLLT

SEQ ID NO: 2838 - protein, 18 aa, Artificial Sequence
  EGFR binding MRD
YEEHCWLFPTDWICTLLT

SEQ ID NO: 2839 - protein, 18 aa, Artificial Sequence
  EGFR binding MRD
YAEHCWQFPTDWICSLSS

SEQ ID NO: 2840 - protein, 18 aa, Artificial Sequence
  EGFR binding MRD
YAAHCWQFPTDWICTLLP

SEQ ID NO: 2841 - protein, 18 aa, Artificial Sequence
  EGFR binding MRD
YAEHCSLFPSDWICSLMT

SEQ ID NO: 2842 - protein, 18 aa, Artificial Sequence
  EGFR binding MRD
YAEHCSQFPCDWICTLLT

SEQ ID NO: 2843 - protein, 18 aa, Artificial Sequence
  EGFR binding MRD
YAEHCCQFPSDWICTLMS

SEQ ID NO: 2844 - protein, 18 aa, Artificial Sequence
  EGFR binding MRD
YAEHCRLFPCDWICTLMT

SEQ ID NO: 2845 - protein, 18 aa, Artificial Sequence
  EGFR binding MRD
YAEHCWLFPTDWICTLLP

SEQ ID NO: 2846 - protein, 18 aa, Artificial Sequence
  EGFR binding MRD
YAEHCWMFPSDWICSLPT

SEQ ID NO: 2847 - protein, 18 aa, Artificial Sequence
  EGFR binding MRD
YADHCEMFPNDWICTLRT

SEQ ID NO: 2848 - protein, 18 aa, Artificial Sequence
  EGFR binding MRD
YAEHCRMFPSDWICTLIP

SEQ ID NO: 2849 - protein, 18 aa, Artificial Sequence
  EGFR binding MRD
YAEHCRLFPTDWICTLTT

SEQ ID NO: 2850 - protein, 18 aa, Artificial Sequence
  EGFR binding MRD
YAEHCSQFPTDWICTLIT

SEQ ID NO: 2851 - protein, 18 aa, Artificial Sequence
  EGFR binding MRD
YEEHCWLFPNDWICSLMT

SEQ ID NO: 2852 - protein, 18 aa, Artificial Sequence
  EGFR binding MRD
YAEHCQLFPSDWICSLET

SEQ ID NO: 2853 - protein, 18 aa, Artificial Sequence
  EGFR binding MRD
YAEHCAQFPTDWICSLIS

SEQ ID NO: 2854 - protein, 18 aa, Artificial Sequence
  EGFR binding MRD
YAQHCYQFPSDWICSLLP

SEQ ID NO: 2855 - protein, 18 aa, Artificial Sequence
  EGFR binding MRD
YAEHCRHFWTDWICSLKT

SEQ ID NO: 2856 - protein, 18 aa, Artificial Sequence
  EGFR binding MRD
YGEHCRSFPTDWICTLLP

SEQ ID NO: 2857 - protein, 18 aa, Artificial Sequence
  EGFR binding MRD
YSTHCRLFPTDWICTLEG

SEQ ID NO: 2858 - protein, 18 aa, Artificial Sequence
  EGFR binding MRD
YAEHCWHFPTDWICSLLP

SEQ ID NO: 2859 - protein, 18 aa, Artificial Sequence
  EGFR binding MRD
YFEHCRQFPTDWICTLMP

SEQ ID NO: 2860 - protein, 18 aa, Artificial Sequence
  EGFR binding MRD
YAEHCRLFPTDWICTIKS

SEQ ID NO: 2861 - protein, 18 aa, Artificial Sequence
  EGFR binding MRD
YVEHCWQFPSDWICTLLP

SEQ ID NO: 2862 - protein, 18 aa, Artificial Sequence
  EGFR binding MRD
YAEHCWRFPGDWICSLIT

SEQ ID NO: 2863 - protein, 18 aa, Artificial Sequence
  EGFR binding MRD
YAEHCRLFPTDWICSLRE

SEQ ID NO: 2864 - protein, 18 aa, Artificial Sequence
  EGFR binding MRD
YAEHCSMFPTDWICTLVT

SEQ ID NO: 2865 - protein, 18 aa, Artificial Sequence
  EGFR binding MRD
YLQHCLLFPTDWICTLLP

SEQ ID NO: 2866 - protein, 18 aa, Artificial Sequence
  EGFR binding MRD
YAEHCTLFPTDWICTLLP

SEQ ID NO: 2867 - protein, 18 aa, Artificial Sequence
  EGFR binding MRD
YAEHCWMFPTDWICSLRS

SEQ ID NO: 2868 - protein, 18 aa, Artificial Sequence
  EGFR binding MRD
YAEHCWLFPKDWICTLIT

SEQ ID NO: 2869 - protein, 18 aa, Artificial Sequence
  EGFR binding MRD
YEEHCWQFPGDWICSLRG

SEQ ID NO: 2870 - protein, 18 aa, Artificial Sequence
  EGFR binding MRD
YAEHCRIFPTDWICTLST

SEQ ID NO: 2871 - protein, 18 aa, Artificial Sequence
  EGFR binding MRD
YAEHCWQFPSDWICSLIE

SEQ ID NO: 2872 - protein, 18 aa, Artificial Sequence
  EGFR binding MRD
YAEHCSHFWTDWICTLST

SEQ ID NO: 2873 - protein, 18 aa, Artificial Sequence
  EGFR binding MRD
YAEHCRQFPSDWICTLLS

SEQ ID NO: 2874 - protein, 18 aa, Artificial Sequence
  EGFR binding MRD
YAAHCSLFPTDWICTLMP

SEQ ID NO: 2875 - protein, 18 aa, Artificial Sequence
  EGFR binding MRD
YAEHCWLFPKDWICTLDM

SEQ ID NO: 2876 - protein, 18 aa, Artificial Sequence
  EGFR binding MRD
YAEHCLQFPADWICTLRT

SEQ ID NO: 2877 - protein, 18 aa, Artificial Sequence
  EGFR binding MRD
YAGHCALFPSDWICSLLP

SEQ ID NO: 2878 - protein, 18 aa, Artificial Sequence
  EGFR binding MRD
YAEHCSYFPTDWICTLRT

SEQ ID NO: 2879 - protein, 18 aa, Artificial Sequence
  EGFR binding MRD
YLDHCRLFPTDWICSLLP

SEQ ID NO: 2880 - protein, 18 aa, Artificial Sequence
  EGFR binding MRD
YVEHCRLFPCDWICSLMI

SEQ ID NO: 2881 - protein, 18 aa, Artificial Sequence
  EGFR binding MRD
YAEHCFQFPHDWICSLMT

SEQ ID NO: 2882 - protein, 18 aa, Artificial Sequence
  EGFR binding MRD
YQEHCWRFPNDWICSLLP

SEQ ID NO: 2883 - protein, 18 aa, Artificial Sequence
  EGFR binding MRD
YAEHCRLFPGDWICTLST

SEQ ID NO: 2884 - protein, 18 aa, Artificial Sequence
  EGFR binding MRD
YAEHCSMFPSDWICSLMT

SEQ ID NO: 2885 - protein, 18 aa, Artificial Sequence
  EGFR binding MRD
YAEHCWHFPTDWICTLRS

SEQ ID NO: 2886 - protein, 18 aa, Artificial Sequence
  EGFR binding MRD
YAEHCGLFPGDWICTLKN

SEQ ID NO: 2887 - protein, 18 aa, Artificial Sequence
  EGFR binding MRD
YAEHCNMFPTDWICTLME

SEQ ID NO: 2888 - protein, 18 aa, Artificial Sequence
  EGFR binding MRD
YAEHCSFFPADWICTLIP

SEQ ID NO: 2889 - protein, 18 aa, Artificial Sequence
  EGFR binding MRD
YAEHCWMFPTDWICSLNR

SEQ ID NO: 2890 - protein, 18 aa, Artificial Sequence
  EGFR binding MRD
YPEHCWQFPGDWICTLLT

SEQ ID NO: 2891 - protein, 18 aa, Artificial Sequence
  EGFR binding MRD
YADHCRLFPTDWICTLVT

SEQ ID NO: 2892 - protein, 18 aa, Artificial Sequence
  EGFR binding MRD
YAEHCRLFPSDWICSLVT

SEQ ID NO: 2893 - protein, 18 aa, Artificial Sequence
  EGFR binding MRD
YAEHCRQFPADWICTLMT

SEQ ID NO: 2894 - protein, 18 aa, Artificial Sequence
  EGFR binding MRD
YSEHCWMFPSDWICTLME

SEQ ID NO: 2895 - protein, 18 aa, Artificial Sequence
  EGFR binding MRD
YAEHCSQFPTDWICTLLT

SEQ ID NO: 2896 - protein, 18 aa, Artificial Sequence
  EGFR binding MRD
LAEHCYLFPCDWICSLLT

SEQ ID NO: 2897 - protein, 18 aa, Artificial Sequence
  EGFR binding MRD
YAEHCWQFPADWICTLLP

SEQ ID NO: 2898 - protein, 18 aa, Artificial Sequence
  EGFR binding MRD
YREHCSLFPNDWICTLMP

SEQ ID NO: 2899 - protein, 18 aa, Artificial Sequence
  EGFR binding MRD
YAEHCSLFPTDWICSLMP

SEQ ID NO: 2900 - protein, 18 aa, Artificial Sequence
  EGFR binding MRD
YEEHCWLFPSDWICSLRQ

SEQ ID NO: 2901 - protein, 18 aa, Artificial Sequence
  EGFR binding MRD
LPEPCWWAPWGRECLLLP

SEQ ID NO: 2902 - protein, 18 aa, Artificial Sequence
  EGFR binding MRD
LPQGCWWAVWGKECHLLP

SEQ ID NO: 2903 - protein, 18 aa, Artificial Sequence
  EGFR binding MRD
LYDTCYWTTWGKECLMPR

SEQ ID NO: 2904 - protein, 18 aa, Artificial Sequence
  EGFR binding MRD
LPDGCTWMVWGRECFLLP

SEQ ID NO: 2905 - protein, 18 aa, Artificial Sequence
  EGFR binding MRD
LPGGCWWAVWGRECQLLP

SEQ ID NO: 2906 - protein, 18 aa, Artificial Sequence
  EGFR binding MRD
HPDDCWWALWGRECLLLP

SEQ ID NO: 2907 - protein, 12 aa, Artificial Sequence
  EGFR binding MRD
KCNFNPWKAACG

SEQ ID NO: 2908 - protein, 18 aa, Artificial Sequence
  EGFR binding MRD
LPEGCWWALWGRECLLLP

SEQ ID NO: 2909 - protein, 18 aa, Artificial Sequence
  EGFR binding MRD
LLDACWWATWGKECIWRN

SEQ ID NO: 2910 - protein, 18 aa, Artificial Sequence
  EGFR binding MRD
LTYVCWWNMWGYECLPYE

SEQ ID NO: 2911 - protein, 18 aa, Artificial Sequence
  EGFR binding MRD
LPDGCWWAQWGRECLLKP

SEQ ID NO: 2912 - protein, 18 aa, Artificial Sequence
  EGFR binding MRD
LPAPCYWTTWGKECFIVP

SEQ ID NO: 2913 - protein, 18 aa, Artificial Sequence
  EGFR binding MRD
LIAPCYWTIWGKECFILD

SEQ ID NO: 2914 - protein, 18 aa, Artificial Sequence
  EGFR binding MRD
HPDNCWWAVWGRECLLLP

SEQ ID NO: 2915 - protein, 18 aa, Artificial Sequence
  EGFR binding MRD
LSDPCYWTTWGKECFLLR

SEQ ID NO: 2916 - protein, 18 aa, Artificial Sequence
  EGFR binding MRD
LTAPCYWTTWGKECLLLR

SEQ ID NO: 2917 - protein, 18 aa, Artificial Sequence
  EGFR binding MRD
LAEGCIWTTWGRECFLLP

SEQ ID NO: 2918 - protein, 18 aa, Artificial Sequence
  EGFR binding MRD
LPDGCYWTVWGRECFLPP

SEQ ID NO: 2919 - protein, 18 aa, Artificial Sequence
  EGFR binding MRD
LRDPCWWAVWGRECILLP

SEQ ID NO: 2920 - protein, 18 aa, Artificial Sequence
  EGFR binding MRD
QSPGCWWAVWGVECILLP

SEQ ID NO: 2921 - protein, 18 aa, Artificial Sequence
  EGFR binding MRD
IHEGCWWSSWGKECLLLP

SEQ ID NO: 2922 - protein, 18 aa, Artificial Sequence
  EGFR binding MRD
LPEGCWWATWGRECLLEP

SEQ ID NO: 2923 - protein, 18 aa, Artificial Sequence
  EGFR binding MRD
LPAGCYWANWGKECFLVP

SEQ ID NO: 2924 - protein, 18 aa, Artificial Sequence
  EGFR binding MRD
LTDPCYWTTWGKECLLHR

SEQ ID NO: 2925 - protein, 18 aa, Artificial Sequence
  EGFR binding MRD
LPEGCWWAPWGKECLLSP

SEQ ID NO: 2926 - protein, 18 aa, Artificial Sequence
  EGFR binding MRD
LPAPCYWTTWGKECLMPR

SEQ ID NO: 2927 - protein, 18 aa, Artificial Sequence
  EGFR binding MRD
LPDGCYWSMWGRECFLVP

SEQ ID NO: 2928 - protein, 18 aa, Artificial Sequence
  EGFR binding MRD
VPQGCYWATWGRECYLLP

SEQ ID NO: 2929 - protein, 18 aa, Artificial Sequence
  EGFR binding MRD
LPDSCWWSTWGRECILLP

SEQ ID NO: 2930 - protein, 18 aa, Artificial Sequence
  EGFR binding MRD
LPAPCYWTTWGKECLLQH

SEQ ID NO: 2931 - protein, 18 aa, Artificial Sequence
  EGFR binding MRD
LQEGCFWAVWGKECILLP

SEQ ID NO: 2932 - protein, 18 aa, Artificial Sequence
  EGFR binding MRD
LNEHCYWALWGKECFLPR

SEQ ID NO: 2933 - protein, 18 aa, Artificial Sequence
  EGFR binding MRD
LPEGCWWSPWGRECLLLP

SEQ ID NO: 2934 - protein, 18 aa, Artificial Sequence
  EGFR binding MRD
LPEGCFWTVWGKECLLMP

SEQ ID NO: 2935 - protein, 18 aa, Artificial Sequence
  EGFR binding MRD
LPDGCYWTTWGKECFMPR

SEQ ID NO: 2936 - protein, 18 aa, Artificial Sequence
  EGFR binding MRD
LPEGCWWSPWGKECLLMP

SEQ ID NO: 2937 - protein, 18 aa, Artificial Sequence
  EGFR binding MRD
LTPPCYWTIWGKECFMRQ

SEQ ID NO: 2938 - protein, 18 aa, Artificial Sequence
  EGFR binding MRD
LPEGCYWSVWGKECLLES

SEQ ID NO: 2939 - protein, 18 aa, Artificial Sequence
  EGFR binding MRD
LTDQCYWATWGRECILLR

SEQ ID NO: 2940 - protein, 18 aa, Artificial Sequence
  EGFR binding MRD
FPDGCYWAIWGRECLLQP

SEQ ID NO: 2941 - protein, 18 aa, Artificial Sequence
  EGFR binding MRD
LSGGCYWTTWGRECILLP

SEQ ID NO: 2942 - protein, 18 aa, Artificial Sequence
  EGFR binding MRD
LSSPCYWTTWGKECFIIR

SEQ ID NO: 2943 - protein, 18 aa, Artificial Sequence
  EGFR binding MRD
FPEGCWWALWGKECFLQP

SEQ ID NO: 2944 - protein, 18 aa, Artificial Sequence
  EGFR binding MRD
LPDGCWWSVWGRECLMLP

SEQ ID NO: 2945 - protein, 18 aa, Artificial Sequence
  EGFR binding MRD
LPEDCWWAIWGRECLLTP

SEQ ID NO: 2946 - protein, 18 aa, Artificial Sequence
  EGFR binding MRD
LPEPCYWTTWGKECFMIH

SEQ ID NO: 2947 - protein, 18 aa, Artificial Sequence
  EGFR binding MRD
LPQGCYWAVWGRECLLLP

SEQ ID NO: 2948 - protein, 18 aa, Artificial Sequence
  EGFR binding MRD
LPAGCWWSLWGKECYLLP

SEQ ID NO: 2949 - protein, 18 aa, Artificial Sequence
  EGFR binding MRD
LPEECWWAIWGRECHLLP

SEQ ID NO: 2950 - protein, 18 aa, Artificial Sequence
  EGFR binding MRD
LPAGCWWSVWGRECLLMP

SEQ ID NO: 2951 - protein, 18 aa, Artificial Sequence
  EGFR binding MRD
MPEGCFWAIWGRECFLLP

SEQ ID NO: 2952 - protein, 18 aa, Artificial Sequence
  EGFR binding MRD
LPDPCWWAPWGRECVLMP

SEQ ID NO: 2953 - protein, 18 aa, Artificial Sequence
  EGFR binding MRD
IPDGCYWAIWGRECFLLP

SEQ ID NO: 2954 - protein, 18 aa, Artificial Sequence
  EGFR binding MRD
LPAPCYWTTWGKECFLLR

SEQ ID NO: 2955 - protein, 18 aa, Artificial Sequence
  EGFR binding MRD
LTDSCYWTTWGRECFLIP

SEQ ID NO: 2956 - protein, 18 aa, Artificial Sequence
  EGFR binding MRD
IHDPCYWTVWGRECLLLP

SEQ ID NO: 2957 - protein, 18 aa, Artificial Sequence
  EGFR binding MRD
LPEGCWWSAWGRECILLQ

SEQ ID NO: 2958 - protein, 18 aa, Artificial Sequence
  EGFR binding MRD
LMGDCWWTVWGKECLLQP

SEQ ID NO: 2959 - protein, 18 aa, Artificial Sequence
  EGFR binding MRD
VPDSCWWSQWGRECLLPP

SEQ ID NO: 2960 - protein, 18 aa, Artificial Sequence
  EGFR binding MRD
LPEGCWWSVWGKECLMLP

SEQ ID NO: 2961 - protein, 18 aa, Artificial Sequence
  EGFR binding MRD
LATPCYWTTWGKECLIPR

SEQ ID NO: 2962 - protein, 18 aa, Artificial Sequence
  EGFR binding MRD
LLLGCSWHFWVYECLPPP

SEQ ID NO: 2963 - protein, 18 aa, Artificial Sequence
  EGFR binding MRD
INPPCYWTTWGKECFLHR

SEQ ID NO: 2964 - protein, 18 aa, Artificial Sequence
  EGFR binding MRD
LPEGCWWTQWGKECHLAP

SEQ ID NO: 2965 - protein, 18 aa, Artificial Sequence
  EGFR binding MRD
FPAGCYWAHWGRECLLLP

SEQ ID NO: 2966 - protein, 18 aa, Artificial Sequence
  EGFR binding MRD
LPEGCWWSIWGKECLLLP

SEQ ID NO: 2967 - protein, 18 aa, Artificial Sequence
  EGFR binding MRD
LPEGCYWAIWGKECHMTP

SEQ ID NO: 2968 - protein, 18 aa, Artificial Sequence
  EGFR binding MRD
IPEGCWWQPWALECFLLP

SEQ ID NO: 2969 - protein, 18 aa, Artificial Sequence
  EGFR binding MRD
IAEGCWWSIWGKECFLLP

SEQ ID NO: 2970 - protein, 18 aa, Artificial Sequence
  EGFR binding MRD
LPEPCYWTTWGKECHLPN

SEQ ID NO: 2971 - protein, 18 aa, Artificial Sequence
  EGFR binding MRD
LPPRCLWNPWGPECFLIH

SEQ ID NO: 2972 - protein, 18 aa, Artificial Sequence
  EGFR binding MRD
LTAPCWWTSWGRECYLFG

SEQ ID NO: 2973 - protein, 18 aa, Artificial Sequence
  EGFR binding MRD
RPDSCYWTTWGRECLWPR

SEQ ID NO: 2974 - protein, 18 aa, Artificial Sequence
  EGFR binding MRD
LPERCWWAIWGRECILLP

SEQ ID NO: 2975 - protein, 18 aa, Artificial Sequence
  EGFR binding MRD
ISQGCWWSKWGRECLLPP

SEQ ID NO: 2976 - protein, 18 aa, Artificial Sequence
  EGFR binding MRD
IPHGCWWAIWGRECLLLP

SEQ ID NO: 2977 - protein, 18 aa, Artificial Sequence
  EGFR binding MRD
YPEHCWWFPSDWICTLMT

SEQ ID NO: 2978 - protein, 18 aa, Artificial Sequence
  EGFR binding MRD
YAEHCWRFPSDWICTLMT

SEQ ID NO: 2979 - protein, 18 aa, Artificial Sequence
  EGFR binding MRD
YADHCRLFPNDWICTLIT

SEQ ID NO: 2980 - protein, 18 aa, Artificial Sequence
  EGFR binding MRD
YAQHCYLFPMDWICTLTT

SEQ ID NO: 2981 - protein, 18 aa, Artificial Sequence
  EGFR binding MRD
YSEHCWQFPDDWICTLMT

SEQ ID NO: 2982 - protein, 18 aa, Artificial Sequence
  EGFR binding MRD
YAEHCRVFPTDWICTLRP

SEQ ID NO: 2983 - protein, 18 aa, Artificial Sequence
  EGFR binding MRD
YGQHCSLFPTDWICSLMT

SEQ ID NO: 2984 - protein, 18 aa, Artificial Sequence
  EGFR binding MRD
YAEHCRQFRTDWICTLMT

SEQ ID NO: 2985 - protein, 18 aa, Artificial Sequence
  EGFR binding MRD
YAEHCLTFPTDWICSLAQ

SEQ ID NO: 2986 - protein, 18 aa, Artificial Sequence
  EGFR binding MRD
YAGHCRDFPSDWICSLVP

SEQ ID NO: 2987 - protein, 17 aa, Artificial Sequence
  EGFR binding MRD
YAEHCWYFPTDWICTLT

SEQ ID NO: 2988 - protein, 18 aa, Artificial Sequence
  EGFR binding MRD
YQEHCWLFPTDWICSLTS

SEQ ID NO: 2989 - protein, 18 aa, Artificial Sequence
  EGFR binding MRD
YADHCCHFPADWICTLNA

SEQ ID NO: 2990 - protein, 18 aa, Artificial Sequence
  EGFR binding MRD
YAEHCWLFPTDWICSLMP

SEQ ID NO: 2991 - protein, 18 aa, Artificial Sequence
  EGFR binding MRD
YADHCLQFPLDWICTLMK

SEQ ID NO: 2992 - protein, 18 aa, Artificial Sequence
  EGFR binding MRD
YAEHCTQFPTDWICTLTS

SEQ ID NO: 2993 - protein, 18 aa, Artificial Sequence
  EGFR binding MRD
YAEHCRQFPSDWICTLMT

SEQ ID NO: 2994 - protein, 18 aa, Artificial Sequence
  EGFR binding MRD
YSEHCYLFPTDWICTLPT

SEQ ID NO: 2995 - protein, 18 aa, Artificial Sequence
  EGFR binding MRD
YVDHCWDFPTDWICTLLS

SEQ ID NO: 2996 - protein, 18 aa, Artificial Sequence
  EGFR binding MRD
YIEHCWQFPTDWICTLMT

SEQ ID NO: 2997 - protein, 18 aa, Artificial Sequence
  EGFR binding MRD
YADHCRFFPTDWICTLMP

SEQ ID NO: 2998 - protein, 18 aa, Artificial Sequence
  EGFR binding MRD
YAQHCMQFPTDWICTLMT

SEQ ID NO: 2999 - protein, 18 aa, Artificial Sequence
  EGFR binding MRD
YADHCWQFPSDWICTLLA

SEQ ID NO: 3000 - protein, 18 aa, Artificial Sequence
  EGFR binding MRD
YARHCMQFPTDWICSLTT

SEQ ID NO: 3001 - protein, 18 aa, Artificial Sequence
  EGFR binding MRD
YAEHCWQFPTDWICTLRS

SEQ ID NO: 3002 - protein, 18 aa, Artificial Sequence
  EGFR binding MRD
YEDHCSLFPKDWICGLMP

SEQ ID NO: 3003 - protein, 18 aa, Artificial Sequence
  EGFR binding MRD
YAEHCWQFPTDWICTLLP

SEQ ID NO: 3004 - protein, 18 aa, Artificial Sequence
  EGFR binding MRD
YEEHCQLFPTDWICTIRT

SEQ ID NO: 3005 - protein, 18 aa, Artificial Sequence
  EGFR binding MRD
YAEHCWLFPTDWICSLMT

SEQ ID NO: 3006 - protein, 18 aa, Artificial Sequence
  EGFR binding MRD
YAEHCWQFPTDWICTLMS

SEQ ID NO: 3007 - protein, 18 aa, Artificial Sequence
  EGFR binding MRD
YAEHCRQFPTDWICGLMT

SEQ ID NO: 3008 - protein, 18 aa, Artificial Sequence
  EGFR binding MRD
YADHCSQFPTDWICTLIP

SEQ ID NO: 3009 - protein, 18 aa, Artificial Sequence
  EGFR binding MRD
YSEHCWLFPTDWICTLVP

SEQ ID NO: 3010 - protein, 18 aa, Artificial Sequence
  EGFR binding MRD
YAAHCWQFPTDWICTLIP

SEQ ID NO: 3011 - protein, 18 aa, Artificial Sequence
  EGFR binding MRD
YAEHCWLFPSDWICTLMP

SEQ ID NO: 3012 - protein, 18 aa, Artificial Sequence
  EGFR binding MRD
YAEHCYMFPTDWICTLTA

SEQ ID NO: 3013 - protein, 18 aa, Artificial Sequence
  EGFR binding MRD
YTEHCWLFPTDWICSLMP

SEQ ID NO: 3014 - protein, 18 aa, Artificial Sequence
  EGFR binding MRD
YEQHCWHFPNDWICTLMT

SEQ ID NO: 3015 - protein, 18 aa, Artificial Sequence
  EGFR binding MRD
YAEHCWLFPTDWICTLMT

SEQ ID NO: 3016 - protein, 18 aa, Artificial Sequence
  EGFR binding MRD
YYEHCTLFPSDWICTLMT

SEQ ID NO: 3017 - protein, 17 aa, Artificial Sequence
  EGFR binding MRD
YEEHCALFPTDWICTLH

SEQ ID NO: 3018 - protein, 18 aa, Artificial Sequence
  EGFR binding MRD
YGEHCWQFPTDWICTLVT

SEQ ID NO: 3019 - protein, 18 aa, Artificial Sequence
  EGFR binding MRD
YSEHCWLFPSDWICSLDT

SEQ ID NO: 3020 - protein, 18 aa, Artificial Sequence
  EGFR binding MRD
YDEHCRQFPTDWICKLTT

SEQ ID NO: 3021 - protein, 18 aa, Artificial Sequence
  EGFR binding MRD
YAEHCYRFPTDWICTLMS

SEQ ID NO: 3022 - protein, 18 aa, Artificial Sequence
  EGFR binding MRD
YAGHCSRFPTDWICTLMA

SEQ ID NO: 3023 - protein, 18 aa, Artificial Sequence
  EGFR binding MRD
YAQHCWQFPADWICTLIE

SEQ ID NO: 3024 - protein, 18 aa, Artificial Sequence
  EGFR binding MRD
YDEHCLKFPADWICSLPR

SEQ ID NO: 3025 - protein, 18 aa, Artificial Sequence
  EGFR binding MRD
YAGHCNLFPTDWICTLKT

SEQ ID NO: 3026 - protein, 18 aa, Artificial Sequence
  EGFR binding MRD
YEEHCGLFPTDWICTLMD

SEQ ID NO: 3027 - protein, 18 aa, Artificial Sequence
  EGFR binding MRD
YSEHCWLFPTDWICTLPT

SEQ ID NO: 3028 - protein, 18 aa, Artificial Sequence
  EGFR binding MRD
YAEHCWMFPTDWICSLLP

SEQ ID NO: 3029 - protein, 18 aa, Artificial Sequence
  EGFR binding MRD
YAEHCWQFPSDWICTLLP

SEQ ID NO: 3030 - protein, 18 aa, Artificial Sequence
  EGFR binding MRD
YAEHCWRFPTDWICTLMT

SEQ ID NO: 3031 - protein, 18 aa, Artificial Sequence
  EGFR binding MRD
YTSHCRHFPNDWICTLLP

SEQ ID NO: 3032 - protein, 18 aa, Artificial Sequence
  EGFR binding MRD
YAEHCWQFPHDWICTLTK

SEQ ID NO: 3033 - protein, 18 aa, Artificial Sequence
  EGFR binding MRD
YADHCWLFPNDWICTLIK

SEQ ID NO: 3034 - protein, 18 aa, Artificial Sequence
  EGFR binding MRD
YAEHCWLFPTDWICTLRT

SEQ ID NO: 3035 - protein, 18 aa, Artificial Sequence
  EGFR binding MRD
FQGHCALFPTDWICTLKS

SEQ ID NO: 3036 - protein, 18 aa, Artificial Sequence
  EGFR binding MRD
YAEHCRLFPADWICSLMT

SEQ ID NO: 3037 - protein, 18 aa, Artificial Sequence
  EGFR binding MRD
YAEHCGLFPTDWICTLMT

SEQ ID NO: 3038 - protein, 18 aa, Artificial Sequence
  EGFR binding MRD
YREHCGQFPNDWICSLLT

SEQ ID NO: 3039 - protein, 18 aa, Artificial Sequence
  EGFR binding MRD
YVEHCYQFPADWICTLKT

SEQ ID NO: 3040 - protein, 18 aa, Artificial Sequence
  EGFR binding MRD
YAEHCRHFPSDWICTLTK

SEQ ID NO: 3041 - protein, 18 aa, Artificial Sequence
  EGFR binding MRD
YAEHCSQFPTDWICSLLT

SEQ ID NO: 3042 - protein, 18 aa, Artificial Sequence
  EGFR binding MRD
YAVHCWQFPADWICSLEM

SEQ ID NO: 3043 - protein, 18 aa, Artificial Sequence
  EGFR binding MRD
YEEHCLQFPADWICTLLP

SEQ ID NO: 3044 - protein, 18 aa, Artificial Sequence
  EGFR binding MRD
YAEHCGMFPNDWICSLTK

SEQ ID NO: 3045 - protein, 18 aa, Artificial Sequence
  EGFR binding MRD
YADHCAHFPTDWICTLMT

SEQ ID NO: 3046 - protein, 18 aa, Artificial Sequence
  EGFR binding MRD
YPEHCWLFPTDWICTLVA

SEQ ID NO: 3047 - protein, 18 aa, Artificial Sequence
  EGFR binding MRD
YAEHCWQFPADWICSLPS

SEQ ID NO: 3048 - protein, 18 aa, Artificial Sequence
  EGFR binding MRD
YAEHCWQFPTDWICSLLD

SEQ ID NO: 3049 - protein, 18 aa, Artificial Sequence
  EGFR binding MRD
YAQHCWMFPADWICTLMT

SEQ ID NO: 3050 - protein, 18 aa, Artificial Sequence
  EGFR binding MRD
YLAHCWHFPNDWICSLLP

SEQ ID NO: 3051 - protein, 18 aa, Artificial Sequence
  EGFR binding MRD
YTKHCQRLPTYKICNLFM

SEQ ID NO: 3052 - protein, 18 aa, Artificial Sequence
  EGFR binding MRD
YSEHCWLFPTDWICHLMP

SEQ ID NO: 3053 - protein, 18 aa, Artificial Sequence
  EGFR binding MRD
YAEHCYNFPSDWICSLLT

SEQ ID NO: 3054 - protein, 18 aa, Artificial Sequence
  EGFR binding MRD
YAEHCWQFPTDWICSLMT

SEQ ID NO: 3055 - protein, 18 aa, Artificial Sequence
  EGFR binding MRD
YEEHCWQFPADWICTLLT

SEQ ID NO: 3056 - protein, 18 aa, Artificial Sequence
  EGFR binding MRD
YAEHCWHFPSDWICTLKE

SEQ ID NO: 3057 - protein, 18 aa, Artificial Sequence
  EGFR binding MRD
YAMHCSQFPSDWICTLMT

SEQ ID NO: 3058 - protein, 18 aa, Artificial Sequence
  EGFR binding MRD
YAEHCRQFPTDWICSLMT

SEQ ID NO: 3059 - protein, 18 aa, Artificial Sequence
  EGFR binding MRD
YEEHCWLFPSDWICTLMP

SEQ ID NO: 3060 - protein, 18 aa, Artificial Sequence
  EGFR binding MRD
YAEHCWLFPTDWICNLIP

SEQ ID NO: 3061 - protein, 18 aa, Artificial Sequence
  EGFR binding MRD
YEKHCYQFPSDWICSLKT

SEQ ID NO: 3062 - protein, 18 aa, Artificial Sequence
  EGFR binding MRD
LPDGCCWLQWGMECHLCP

SEQ ID NO: 3063 - protein, 18 aa, Artificial Sequence
  EGFR binding MRD
IPDDCYWTVWGRECLLVP

SEQ ID NO: 3064 - protein, 18 aa, Artificial Sequence
  EGFR binding MRD
LTDGCYWTIWGRECLLLP

SEQ ID NO: 3065 - protein, 18 aa, Artificial Sequence
  EGFR binding MRD
LPDGCWWSTWGRECLLVP

SEQ ID NO: 3066 - protein, 18 aa, Artificial Sequence
  EGFR binding MRD
LPEGCYWAIWGKECLLPL

SEQ ID NO: 3067 - protein, 18 aa, Artificial Sequence
  EGFR binding MRD
DPYGCYWAAWGRECLLLP

SEQ ID NO: 3068 - protein, 18 aa, Artificial Sequence
  EGFR binding MRD
LPEGCWWSVWGRECLLPS

SEQ ID NO: 3069 - protein, 18 aa, Artificial Sequence
  EGFR binding MRD
LPEDCWWATWGRECLLQP

SEQ ID NO: 3070 - protein, 18 aa, Artificial Sequence
  EGFR binding MRD
LPEGCHWAIWGRECLLPP

SEQ ID NO: 3071 - protein, 18 aa, Artificial Sequence
  EGFR binding MRD
LPEGCWWANWGRECLLLP

SEQ ID NO: 3072 - protein, 18 aa, Artificial Sequence
  EGFR binding MRD
IPEGCWWAQWGRECILAA

SEQ ID NO: 3073 - protein, 18 aa, Artificial Sequence
  EGFR binding MRD
ISDGCFWAVWGRECLLAA

SEQ ID NO: 3074 - protein, 18 aa, Artificial Sequence
  EGFR binding MRD
GTDGCWWEVWGRECLLTP

SEQ ID NO: 3075 - protein, 18 aa, Artificial Sequence
  EGFR binding MRD
LPEGCWWSPWGRECLLPP

SEQ ID NO: 3076 - protein, 18 aa, Artificial Sequence
  EGFR binding MRD
LTEPCYWTTWGKECHMPR

SEQ ID NO: 3077 - protein, 18 aa, Artificial Sequence
  EGFR binding MRD
DEAGCWWEIWGRECILSP

SEQ ID NO: 3078 - protein, 18 aa, Artificial Sequence
  EGFR binding MRD
IHDHCCWTIWGYECQLCP

SEQ ID NO: 3079 - protein, 18 aa, Artificial Sequence
  EGFR binding MRD
LHDGCWWEVWGRECFVPS

SEQ ID NO: 3080 - protein, 18 aa, Artificial Sequence
  EGFR binding MRD
FPDVCYWTVWGRECLLLP

SEQ ID NO: 3081 - protein, 18 aa, Artificial Sequence
  EGFR binding MRD
HPDGCYWTVWGRECLLPP

SEQ ID NO: 3082 - protein, 18 aa, Artificial Sequence
  EGFR binding MRD
YSEVCWWEVWGRECFLRS

SEQ ID NO: 3083 - protein, 18 aa, Artificial Sequence
  EGFR binding MRD
LPEDCWWAQWGRECFLPA

SEQ ID NO: 3084 - protein, 18 aa, Artificial Sequence
  EGFR binding MRD
LNDPCYWTTWGKECLLPR

SEQ ID NO: 3085 - protein, 18 aa, Artificial Sequence
  EGFR binding MRD
YEEHCGQFPTDWICTLIS

SEQ ID NO: 3086 - protein, 18 aa, Artificial Sequence
  EGFR binding MRD
YEEHCWLFPSDWICTLMT

SEQ ID NO: 3087 - protein, 18 aa, Artificial Sequence
  EGFR binding MRD
YEEHCWLFPTDWICTLVT

SEQ ID NO: 3088 - protein, 18 aa, Artificial Sequence
  EGFR binding MRD
YAEHCWLFPSDWICTLLT

SEQ ID NO: 3089 - protein, 44 aa, Artificial Sequence
  EGFR binding MRD
YAEHCCRFPSDWICTLMSGQAAAGGSQAQICRLLPSDRVCTLMP

SEQ ID NO: 3090 - protein, 19 aa, Artificial Sequence
  EGFR binding MRD
PESWCHTLYWNLQHCLSQE

SEQ ID NO: 3091 - protein, 18 aa, Artificial Sequence
  EGFR binding MRD
LPEGCYWATWGKECLLQP

SEQ ID NO: 3092 - protein, 18 aa, Artificial Sequence
  EGA79
LTAPCYWTTWGKECLMLR

SEQ ID NO: 3093 - protein, 18 aa, Artificial Sequence
  EGA191
LNDNCYWTTWGRECYLLR

SEQ ID NO: 3094 - protein, 18 aa, Artificial Sequence
  EGA214
FSDPCYWTTWGRECFLLP

SEQ ID NO: 3095 - protein, 18 aa, Artificial Sequence
  EGA234
LPEGCYWTTWGKECLLLP

SEQ ID NO: 3096 - protein, 18 aa, Artificial Sequence
  EGA626
LPQGCVWTNWGKECYLPL

SEQ ID NO: 3097 - protein, 18 aa, Artificial Sequence
  EGA623
LPEGCWWSQWGKECLLLP

SEQ ID NO: 3098 - protein, 18 aa, Artificial Sequence
  EGA625
LPQECYWAHWGKECYLPP

SEQ ID NO: 3099 - protein, 18 aa, Artificial Sequence
  EGA673
LPEGCWWAPWGKECLLHP

SEQ ID NO: 3100 - protein, 18 aa, Artificial Sequence
  EGA990
LPEDCWWSTWGRECLLPP

SEQ ID NO: 3101 - protein, 19 aa, Artificial Sequence
  EGA349
ADSWCHTLYWQLHHCASWE

SEQ ID NO: 3102 - protein, 19 aa, Artificial Sequence
  EGA406
EESLCHTLYRQLHNCRSLE

SEQ ID NO: 3103 - protein, 19 aa, Artificial Sequence
  EGA466
ADSLCLTEYLELLQCERWE

SEQ ID NO: 3104 - protein, 19 aa, Artificial Sequence
  EGA467
ADSLCQTRHQQLLDCERQE

SEQ ID NO: 3105 - protein, 19 aa, Artificial Sequence
  EGA433
PESWCHTLYWNLQHCLSQE

SEQ ID NO: 3106 - protein, 18 aa, Artificial Sequence
  EGA518
YAEHCWQFPTDWICTLMT

SEQ ID NO: 3107 - protein, 18 aa, Artificial Sequence
  EGA771
YAEHCLMFPGDWICTLLP

SEQ ID NO: 3108 - protein, 18 aa, Artificial Sequence
  EGA772
YASHCSQFPGDWICSLMT

SEQ ID NO: 3109 - protein, 18 aa, Artificial Sequence
  EGA797
YAEHCRQFPSDWICTLLP

SEQ ID NO: 3110 - protein, 18 aa, Artificial Sequence
  EGA926
YADHCSQFPNDWICTLLS

SEQ ID NO: 3111 - protein, 18 aa, Artificial Sequence
  EGA958
YAEHCSLFPTDWICTLMS

SEQ ID NO: 3112 - protein, 18 aa, Artificial Sequence
  EGA917
YAEHCSQFPSDWICSLLS

SEQ ID NO: 3113 - protein, 12 aa, Artificial Sequence
  ErbB2 binding MRD
LCFAHQQAMFCN

SEQ ID NO: 3114 - protein, 12 aa, Artificial Sequence
  ErbB2 binding MRD
TCHPSWGGKTCT

SEQ ID NO: 3115 - protein, 10 aa, Artificial Sequence
  ErbB2 binding MRD
ICVAMTVTCS

SEQ ID NO: 3116 - protein, 12 aa, Artificial Sequence
  ErbB2 binding MRD
FCIHFPHSWVCH

SEQ ID NO: 3117 - protein, 12 aa, Artificial Sequence
  ErbB2 binding MRD
WCHLFPYSQWCH

SEQ ID NO: 3118 - protein, 12 aa, Artificial Sequence
  ErbB2 binding MRD
ICKYFPFSHFCW

SEQ ID NO: 3119 - protein, 10 aa, Artificial Sequence
  ErbB2 binding MRD
WDHWHIWHFG

SEQ ID NO: 3120 - protein, 35 aa, Artificial Sequence
  ErbB2 binding MRD
LCETQPVSFSCSGQACPGGGGGSLCQFWPHIDFCV

SEQ ID NO: 3121 - protein, 12 aa, Artificial Sequence
  ErbB2 binding MRD
WCHFQIWHHPCY

SEQ ID NO: 3122 - protein, 12 aa, Artificial Sequence
  ErbB2 binding MRD
FCQFFPWTMVCQ

SEQ ID NO: 3123 - protein, 10 aa, Artificial Sequence
  ErbB2 binding MRD
MPWEYLHQHQ

SEQ ID NO: 3124 - protein, 38 aa, Artificial Sequence
  ErbB2 binding MRD
HCNWAPWWGYCMGQAGQGRCTAGGGSHCYWPPPNTRCW

SEQ ID NO: 3125 - protein, 10 aa, Artificial Sequence
  ErbB2 binding MRD
PCVFVIEGCF

SEQ ID NO: 3126 - protein, 35 aa, Artificial Sequence
  ErbB2 binding MRD
ICSRWPYWPHCWGQARQAAGGGSNCSHEPGSVVCL

SEQ ID NO: 3127 - protein, 10 aa, Artificial Sequence
  ErbB2 binding MRD
WCRYYSVVCS

SEQ ID NO: 3128 - protein, 10 aa, Artificial Sequence
  ErbB2 binding MRD
ICWIGTFGCA

SEQ ID NO: 3129 - protein, 20 aa, Artificial Sequence
  ErbB2 binding MRD
PPYRCIPSESWICSFILGQA

SEQ ID NO: 3130 - protein, 20 aa, Artificial Sequence
  ErbB2 binding MRD
QGGGCRGPHWYQMFYCVSPS

SEQ ID NO: 3131 - protein, 17 aa, Artificial Sequence
  ErbB2 binding MRD
LVSFCPWGPDWYCSHYH

SEQ ID NO: 3132 - protein, 20 aa, Artificial Sequence
  ErbB2 binding MRD
PPRWWCEHYGVQDLMCPGLF

SEQ ID NO: 3133 - protein, 17 aa, Artificial Sequence
  ErbB2 binding MRD
SVFDCKYAPMWYCKHYL

SEQ ID NO: 3134 - protein, 16 aa, Artificial Sequence
  ErbB2 binding MRD
GSLGCVLPMVFCRSYQ

SEQ ID NO: 3135 - protein, 16 aa, Artificial Sequence
  ErbB2 binding MRD
YGKVLCSKWQCCKLLR

SEQ ID NO: 3136 - protein, 16 aa, Artificial Sequence
  ErbB2 binding MRD
FCHLCQMFPAWCFLQT

SEQ ID NO: 3137 - protein, 20 aa, Artificial Sequence
  ErbB2 binding MRD
RWVHCKQHGHYFSQRCIETW

SEQ ID NO: 3138 - protein, 19 aa, Artificial Sequence
  ErbB2 binding MRD
PRRWCHMDFHHSPMCHWHL

SEQ ID NO: 3139 - protein, 19 aa, Artificial Sequence
  ErbB2 binding MRD
HTRKCHKFMFQHKHCIEVL

SEQ ID NO: 3140 - protein, 54 aa, Artificial Sequence
  ErbB2 binding MRD
MVVPCFTSQRQMAPACIAPRGQAGQGGPGCGRWLPRQRCFIKHGHMSESCMVSA

SEQ ID NO: 3141 - protein, 20 aa, Artificial Sequence
  ErbB2 binding MRD
YGKKCDKHDHSKPGVCIKKY

SEQ ID NO: 3142 - protein, 18 aa, Artificial Sequence
  ErbB2 binding MRD
LLFDCWRIPEWHACGKDY

SEQ ID NO: 3143 - protein, 20 aa, Artificial Sequence
  ErbB2 binding MRD
WNRICMYQWANHFTVCAPGP

SEQ ID NO: 3144 - protein, 20 aa, Artificial Sequence
  ErbB2 binding MRD
ERALCHKPWSHIMPWCPQKL

SEQ ID NO: 3145 - protein, 19 aa, Artificial Sequence
  ErbB2 binding MRD
WKPWCKLYWRADPACLQIK

SEQ ID NO: 3146 - protein, 18 aa, Artificial Sequence
  ErbB2 binding MRD
WSGWCMYTWGWAPCRSVD

SEQ ID NO: 3147 - protein, 18 aa, Artificial Sequence
  ErbB2 binding MRD
WSGWCVKQNAWYFCTGKI

SEQ ID NO: 3148 - protein, 22 aa, Artificial Sequence
  ErbB2 binding MRD
VAQSSAFCEEFPVHWYCSFYVG

SEQ ID NO: 3149 - protein, 20 aa, Artificial Sequence
  ErbB2 binding MRD
VAQSTPSCGMPKWYCIHYFG

SEQ ID NO: 3150 - protein, 22 aa, Artificial Sequence
  ErbB2 binding MRD
VAQSSEHCYFGWNSYHCWSQAG

SEQ ID NO: 3151 - protein, 18 aa, Artificial Sequence
  ErbB2 binding MRD
VAQREKHCVPEWYCKHYM

SEQ ID NO: 3152 - protein, 20 aa, Artificial Sequence
  ErbB2 binding MRD
WSGWCWSDESKYWYSCHSRA

SEQ ID NO: 3153 - protein, 18 aa, Artificial Sequence
  ErbB2 binding MRD
WSGLCLWDMFWQQCHGSS

SEQ ID NO: 3154 - protein, 20 aa, Artificial Sequence
  ErbB2 binding MRD
SVLGCDDVGFYQCLEFLGQA

SEQ ID NO: 3155 - protein, 19 aa, Artificial Sequence
  ErbB2 binding MRD
WSGWCQFKDGQWAKCTGRV

SEQ ID NO: 3156 - protein, 20 aa, Artificial Sequence
  ErbB2 binding MRD
WSGYCFDSTHEGWYQCGAVS

SEQ ID NO: 3157 - protein, 18 aa, Artificial Sequence
  ErbB2 binding MRD
WSGWCFHETHWQHCSAGG

SEQ ID NO: 3158 - protein, 18 aa, Artificial Sequence
  ErbB2 binding MRD
WTGWCLVENQWTYCQNGD

SEQ ID NO: 3159 - protein, 18 aa, Artificial Sequence
  ErbB2 binding MRD
WSGWCFEEAGWGHCMGLP

SEQ ID NO: 3160 - protein, 18 aa, Artificial Sequence
  ErbB2 binding MRD
WSGYCFDRGYWQQCSSAW

SEQ ID NO: 3161 - protein, 18 aa, Artificial Sequence
  ErbB2 binding MRD
WSGYCYVFDHWESCRGRE

SEQ ID NO: 3162 - protein, 18 aa, Artificial Sequence
  ErbB2 binding MRD
WSGWCFKEAGWGHCMGLP

SEQ ID NO: 3163 - protein, 18 aa, Artificial Sequence
  ErbB2 binding MRD
WSGCCHWEAAWNNCGGWT

SEQ ID NO: 3164 - protein, 18 aa, Artificial Sequence
  ErbB2 binding MRD
WSGWCMISNQWRHCGSPD

SEQ ID NO: 3165 - protein, 18 aa, Artificial Sequence
  ErbB2 binding MRD
WTGWCEGHGQWGWCHSSL

SEQ ID NO: 3166 - protein, 18 aa, Artificial Sequence
  ErbB2 binding MRD
WVVSCHTSTQVLMCVCLL

SEQ ID NO: 3167 - protein, 18 aa, Artificial Sequence
  ErbB2 binding MRD
WSGYCNSNGAWMMCGGGT

SEQ ID NO: 3168 - protein, 18 aa, Artificial Sequence
  ErbB2 binding MRD
WSGWCFEQAGWGHCLGLP

SEQ ID NO: 3169 - protein, 18 aa, Artificial Sequence
  ErbB2 binding MRD
WSGWCQSHGEWMRCRSWT

SEQ ID NO: 3170 - protein, 18 aa, Artificial Sequence
  ErbB2 binding MRD
WSGWCEEQFGWSQCRRSP

SEQ ID NO: 3171 - protein, 18 aa, Artificial Sequence
  ErbB2 binding MRD
WSGWCFQETHWQHCMGLR

SEQ ID NO: 3172 - protein, 18 aa, Artificial Sequence
  ErbB2 binding MRD
WTGFCFDENHWYICGTGR

SEQ ID NO: 3173 - protein, 18 aa, Artificial Sequence
  ErbB2 binding MRD
WRGWCQIAGEWQHCSNYS

SEQ ID NO: 3174 - protein, 20 aa, Artificial Sequence
  ErbB2 binding MRD
WTGYCVDQERHQWHQCFGRS

SEQ ID NO: 3175 - protein, 20 aa, Artificial Sequence
  ErbB2 binding MRD
WQGYCYQEVYALWDHCSGPL

SEQ ID NO: 3176 - protein, 20 aa, Artificial Sequence
  ErbB2 binding MRD
WSGWCFAMEHQKWKQCAGSS

SEQ ID NO: 3177 - protein, 18 aa, Artificial Sequence
  ErbB2 binding MRD
GSMLCLWFNDNPQCFEVC

SEQ ID NO: 3178 - protein, 18 aa, Artificial Sequence
  ErbB2 binding MRD
WSGWCETPHQWHDCKGTI

SEQ ID NO: 3179 - protein, 18 aa, Artificial Sequence
  ErbB2 binding MRD
MIEFCWYYMALPECWIPT

SEQ ID NO: 3180 - protein, 18 aa, Artificial Sequence
  ErbB2 binding MRD
IIEFCWYLQQYDECWVPK

SEQ ID NO: 3181 - protein, 18 aa, Artificial Sequence
  ErbB2 binding MRD
WSGYCYEGVTWRSCWGDM

SEQ ID NO: 3182 - protein, 18 aa, Artificial Sequence
  ErbB2 binding MRD
WSGWCFQFDNWDHCTGSV

SEQ ID NO: 3183 - protein, 16 aa, Artificial Sequence
  ErbB2 binding MRD
SFTLTCGAHQCLCHVL

SEQ ID NO: 3184 - protein, 20 aa, Artificial Sequence
  ErbB2 binding MRD
WSGWCQHMQVPIWHACSGGL

SEQ ID NO: 3185 - protein, 18 aa, Artificial Sequence
  ErbB2 binding MRD
WSGLCLTEEVWHVCQGTI

SEQ ID NO: 3186 - protein, 20 aa, Artificial Sequence
  ErbB2 binding MRD
WTGFCQSSKTQKWQHCRGGG

SEQ ID NO: 3187 - protein, 18 aa, Artificial Sequence
  ErbB2 binding MRD
WSGWCEEELQWSFCSGHL

SEQ ID NO: 3188 - protein, 20 aa, Artificial Sequence
  ErbB2 binding MRD
WSGYCVDFEFPAWGYCHGNI

SEQ ID NO: 3189 - protein, 20 aa, Artificial Sequence
  ErbB2 binding MRD
WSGWCYSQALMSWTYCHEFK

SEQ ID NO: 3190 - protein, 20 aa, Artificial Sequence
  ErbB2 binding MRD
WSGWCFYQVEYIWRSCEPAS

SEQ ID NO: 3191 - protein, 17 aa, Artificial Sequence
  ErbB2 binding MRD
NRSGCIEIHYEDCLLIV

SEQ ID NO: 3192 - protein, 18 aa, Artificial Sequence
  ErbB2 binding MRD
WTGWCYMEHFWDICHGPA

SEQ ID NO: 3193 - protein, 20 aa, Artificial Sequence
  ErbB2 binding MRD
WTGYCLSSERHKWHHCFGRS

SEQ ID NO: 3194 - protein, 18 aa, Artificial Sequence
  ErbB2 binding MRD
WSGWCFQFDNWDRCPGSV

SEQ ID NO: 3195 - protein, 18 aa, Artificial Sequence
  ErbB2 binding MRD
WSGYCQMKDHWAHCGHSE

SEQ ID NO: 3196 - protein, 18 aa, Artificial Sequence
  ErbB2 binding MRD
WSGWCLFADGWGHCYGVI

SEQ ID NO: 3197 - protein, 18 aa, Artificial Sequence
  ErbB2 binding MRD
WSGWCFIKTHWGHCYGQI

SEQ ID NO: 3198 - protein, 18 aa, Artificial Sequence
  ErbB2 binding MRD
WSGWCFYVDHWDYCGGLI

SEQ ID NO: 3199 - protein, 18 aa, Artificial Sequence
  ErbB2 binding MRD
WSGYCEGTDHWYHCGGSM

SEQ ID NO: 3200 - protein, 18 aa, Artificial Sequence
  ErbB2 binding MRD
WSGWCFYGDRWGHCSGLP

SEQ ID NO: 3201 - protein, 18 aa, Artificial Sequence
  ErbB2 binding MRD
WSGWCFYGSYWGHCKGIL

SEQ ID NO: 3202 - protein, 18 aa, Artificial Sequence
  ErbB2 binding MRD
WSGYCEFEDHWDYCGTPK

SEQ ID NO: 3203 - protein, 18 aa, Artificial Sequence
  ErbB2 binding MRD
WSGWCLMETGWGHCKGLP

SEQ ID NO: 3204 - protein, 18 aa, Artificial Sequence
  ErbB2 binding MRD
WSGWCFSADGWGHCRGVI

SEQ ID NO: 3205 - protein, 18 aa, Artificial Sequence
  ErbB2 binding MRD
WSGYCDMGDHWSHCGHSG

SEQ ID NO: 3206 - protein, 18 aa, Artificial Sequence
  ErbB2 binding MRD
WSGWCFYGSWWDYCSGGH

SEQ ID NO: 3207 - protein, 18 aa, Artificial Sequence
  ErbB2 binding MRD
WSGYCEFEDHWDFCGTSR

SEQ ID NO: 3208 - protein, 45 aa, Artificial Sequence
  ErbB2 binding MRD
WSGYCEYQDRWAHCGGTPGQAGQGGGSWSGYCRTEGHWAHCGGSV

SEQ ID NO: 3209 - protein, 18 aa, Artificial Sequence
  ErbB2 binding MRD
WSGWCLGEAGWGHCRGLL

SEQ ID NO: 3210 - protein, 18 aa, Artificial Sequence
  ErbB2 binding MRD
WSGWCLYESGWGHCYGWI

SEQ ID NO: 3211 - protein, 18 aa, Artificial Sequence
  ErbB2 binding MRD
WSGYCEYKYKWDHCGTSV

SEQ ID NO: 3212 - protein, 18 aa, Artificial Sequence
  ErbB2 binding MRD
WSGYCEFKDHWAHCGGSL

SEQ ID NO: 3213 - protein, 18 aa, Artificial Sequence
  ErbB2 binding MRD
WSGWCLGETGWGHCSGMP

SEQ ID NO: 3214 - protein, 18 aa, Artificial Sequence
  ErbB2 binding MRD
WSGYCEFKDHWAHCGGSV

SEQ ID NO: 3215 - protein, 18 aa, Artificial Sequence
  ErbB2 binding MRD
WSGYCEFQDHWGYCGNTE

SEQ ID NO: 3216 - protein, 18 aa, Artificial Sequence
  ErbB2 binding MRD
WSGYCEFKDYWAHCSGSM

SEQ ID NO: 3217 - protein, 18 aa, Artificial Sequence
  ErbB2 binding MRD
WSGYCEYSDHWAHCGGSL

SEQ ID NO: 3218 - protein, 18 aa, Artificial Sequence
  ErbB2 binding MRD
WSGWCLYDAGWGYCSGLQ

SEQ ID NO: 3219 - protein, 18 aa, Artificial Sequence
  ErbB2 binding MRD
WSGYCEMQDHWDYCSGSI

SEQ ID NO: 3220 - protein, 18 aa, Artificial Sequence
  ErbB2 binding MRD
WSGWCFTEGVWGHCKGLG

SEQ ID NO: 3221 - protein, 18 aa, Artificial Sequence
  ErbB2 binding MRD
WSGYCEFKDHWDFCGHSA

SEQ ID NO: 3222 - protein, 18 aa, Artificial Sequence
  ErbB2 binding MRD
WSGWCFLDSGWGHCQGLI

SEQ ID NO: 3223 - protein, 18 aa, Artificial Sequence
  ErbB2 binding MRD
WSGWCFNSNGWYQCGGLI

SEQ ID NO: 3224 - protein, 18 aa, Artificial Sequence
  ErbB2 binding MRD
WSGWCFFGASWGHCSGFP

SEQ ID NO: 3225 - protein, 18 aa, Artificial Sequence
  ErbB2 binding MRD
WSGWCFFGAGWDYCHGQP

SEQ ID NO: 3226 - protein, 18 aa, Artificial Sequence
  ErbB2 binding MRD
WSGYCEFKDHWDYCGGSE

SEQ ID NO: 3227 - protein, 18 aa, Artificial Sequence
  ErbB2 binding MRD
WSGWCFYGTGWGYCYGLI

SEQ ID NO: 3228 - protein, 18 aa, Artificial Sequence
  ErbB2 binding MRD
WSGYCEYKHHWAHCGTRH

SEQ ID NO: 3229 - protein, 18 aa, Artificial Sequence
  ErbB2 binding MRD
WSGYCLMKDHWAHCGHSE

SEQ ID NO: 3230 - protein, 18 aa, Artificial Sequence
  ErbB2 binding MRD
WSGWCMGMSGWDHCRGLI

SEQ ID NO: 3231 - protein, 18 aa, Artificial Sequence
  ErbB2 binding MRD
WSGYCEINGKWDYCSHSH

SEQ ID NO: 3232 - protein, 18 aa, Artificial Sequence
  ErbB2 binding MRD
WSGWCFFGAGWGHCFGNP

SEQ ID NO: 3233 - protein, 18 aa, Artificial Sequence
  ErbB2 binding MRD
WSGWCLQGAGWGHCSGRI

SEQ ID NO: 3234 - protein, 18 aa, Artificial Sequence
  ErbB2 binding MRD
WSGWCFNGVGWGHCFGLI

SEQ ID NO: 3235 - protein, 18 aa, Artificial Sequence
  ErbB2 binding MRD
WSGWCFYEAFWGHCTGPT

SEQ ID NO: 3236 - protein, 18 aa, Artificial Sequence
  ErbB2 binding MRD
WSGWCFDGDGWGYCTGVS

SEQ ID NO: 3237 - protein, 18 aa, Artificial Sequence
  ErbB2 binding MRD
WSGWCLRSNGWDYCHGPT

SEQ ID NO: 3238 - protein, 18 aa, Artificial Sequence
  ErbB2 binding MRD
WSGWCLSGAGWGYCSGLP

SEQ ID NO: 3239 - protein, 18 aa, Artificial Sequence
  ErbB2 binding MRD
WSGWCFFGSAWGHCHGFP

SEQ ID NO: 3240 - protein, 18 aa, Artificial Sequence
  ErbB2 binding MRD
WSGWCFYSTHWAQCKGGH

SEQ ID NO: 3241 - protein, 18 aa, Artificial Sequence
  ErbB2 binding MRD
WSGWCETDRGWSFCSSPL

SEQ ID NO: 3242 - protein, 18 aa, Artificial Sequence
  ErbB2 binding MRD
WSGWCESELQWGFCSGLL

SEQ ID NO: 3243 - protein, 18 aa, Artificial Sequence
  ErbB2 binding MRD
WSGWCEGETQWYFCSGHL

SEQ ID NO: 3244 - protein, 18 aa, Artificial Sequence
  ErbB2 binding MRD
WSGWCEYELQWSFCSGQL

SEQ ID NO: 3245 - protein, 18 aa, Artificial Sequence
  ErbB2 binding MRD
WSGWCEGEREWFFCSGHI

SEQ ID NO: 3246 - protein, 18 aa, Artificial Sequence
  ErbB2 binding MRD
WSGWCEYEHHWDFCSGHL

SEQ ID NO: 3247 - protein, 18 aa, Artificial Sequence
  ErbB2 binding MRD
LPPPCYWTTWGKECQMFD

SEQ ID NO: 3248 - protein, 18 aa, Artificial Sequence
  ErbB2 binding MRD
WSGWCFSSSGWGFCGGLN

SEQ ID NO: 3249 - protein, 18 aa, Artificial Sequence
  ErbB2 binding MRD
WSGWCFSPAGWGHCYGLS

SEQ ID NO: 3250 - protein, 18 aa, Artificial Sequence
  ErbB2 binding MRD
WSGWCLDRAGWGHCHGLI

SEQ ID NO: 3251 - protein, 18 aa, Artificial Sequence
  ErbB2 binding MRD
WSGWCLTKSGWGHCLGPT

SEQ ID NO: 3252 - protein, 18 aa, Artificial Sequence
  ErbB2 binding MRD
WSGWCLYEFGWGYCSGLI

SEQ ID NO: 3253 - protein, 18 aa, Artificial Sequence
  ErbB2 binding MRD
WSGWCEYELHWSYCWGPL

SEQ ID NO: 3254 - protein, 18 aa, Artificial Sequence
  ErbB2 binding MRD
WSGWCEGELYWSYCSGYL

SEQ ID NO: 3255 - protein, 18 aa, Artificial Sequence
  ErbB2 binding MRD
WSGWCEYELSWSFCSGSL

SEQ ID NO: 3256 - protein, 18 aa, Artificial Sequence
  ErbB2 binding MRD
WSGWCEYEGFWSFCSGNL

SEQ ID NO: 3257 - protein, 18 aa, Artificial Sequence
  ErbB2 binding MRD
WSGWCEGVLQWYFCSGHI

SEQ ID NO: 3258 - protein, 18 aa, Artificial Sequence
  ErbB2 binding MRD
WSGWCEYDLHWSFCSGHL

SEQ ID NO: 3259 - protein, 18 aa, Artificial Sequence
  ErbB2 binding MRD
WSGWCLGKAGWGHCGGLI

SEQ ID NO: 3260 - protein, 18 aa, Artificial Sequence
  ErbB2 binding MRD
WSGWCFFGSHWGHCFGSP

SEQ ID NO: 3261 - protein, 18 aa, Artificial Sequence
  ErbB2 binding MRD
WSGWCLLDAEWGHCSGLI

SEQ ID NO: 3262 - protein, 18 aa, Artificial Sequence
  ErbB2 binding MRD
WSGWCLSNDGWGHCWGLM

SEQ ID NO: 3263 - protein, 18 aa, Artificial Sequence
  ErbB2 binding MRD
WSGWCLSGTGWGHCYGLH

SEQ ID NO: 3264 - protein, 18 aa, Artificial Sequence
  ErbB2 binding MRD
WSGWCLVGTQWSFCSGLI

SEQ ID NO: 3265 - protein, 18 aa, Artificial Sequence
  ErbB2 binding MRD
WSGWCEKEFLWTFCSGTI

SEQ ID NO: 3266 - protein, 18 aa, Artificial Sequence
  ErbB2 binding MRD
WSGWCESDTHWSFCSGQL

SEQ ID NO: 3267 - protein, 18 aa, Artificial Sequence
  ErbB2 binding MRD
WSGWCEGVSEWSFCSGLI

SEQ ID NO: 3268 - protein, 18 aa, Artificial Sequence
  ErbB2 binding MRD
WSGWCLGLDGWDHCYGRP

SEQ ID NO: 3269 - protein, 18 aa, Artificial Sequence
  ErbB2 binding MRD
WSGWCFFGDRWGHCHGQP

SEQ ID NO: 3270 - protein, 18 aa, Artificial Sequence
  ErbB2 binding MRD
WSGWCFVGASWGHCYGMI

SEQ ID NO: 3271 - protein, 18 aa, Artificial Sequence
  ErbB2 binding MRD
WSGWCLSDAGWGACGGAS

SEQ ID NO: 3272 - protein, 18 aa, Artificial Sequence
  ErbB2 binding MRD
WSGWCLEWNGWGHCSGIP

SEQ ID NO: 3273 - protein, 18 aa, Artificial Sequence
  ErbB2 binding MRD
WSGWCEGELQWFFCSGTI

SEQ ID NO: 3274 - protein, 18 aa, Artificial Sequence
  ErbB2 binding MRD
WSGWCEGEHHWYFCRGNF

SEQ ID NO: 3275 - protein, 18 aa, Artificial Sequence
  ErbB2 binding MRD
WSGYCEGEQQWFYCSGQV

SEQ ID NO: 3276 - protein, 18 aa, Artificial Sequence
  ErbB2 binding MRD
WSGWCENKVGWSFCSGHI

SEQ ID NO: 3277 - protein, 18 aa, Artificial Sequence
  ErbB2 binding MRD
WSGWCEGERTWHFCSGPL

SEQ ID NO: 3278 - protein, 18 aa, Artificial Sequence
  ErbB2 binding MRD
WSGWCCFGTSWGYCHGPP

SEQ ID NO: 3279 - protein, 18 aa, Artificial Sequence
  ErbB2 binding MRD
WSGWCLLDAGWGHCKGML

SEQ ID NO: 3280 - protein, 18 aa, Artificial Sequence
  ErbB2 binding MRD
WSGWCFYGHGWGHCHGTP

SEQ ID NO: 3281 - protein, 18 aa, Artificial Sequence
  ErbB2 binding MRD
WSGWCFDYTRWGHCSGMP

SEQ ID NO: 3282 - protein, 18 aa, Artificial Sequence
  ErbB2 binding MRD
WSGWCLFSAGWGHCSGLI

SEQ ID NO: 3283 - protein, 18 aa, Artificial Sequence
  ErbB2 binding MRD
WSGWCEGELQWSFCWGHI

SEQ ID NO: 3284 - protein, 18 aa, Artificial Sequence
  ErbB2 binding MRD
WSGWCEEEHQWSFCSGYI

SEQ ID NO: 3285 - protein, 18 aa, Artificial Sequence
  ErbB2 binding MRD
WSGWCEGEREWYFCSGFF

SEQ ID NO: 3286 - protein, 18 aa, Artificial Sequence
  ErbB2 binding MRD
WSGWCEGKLKWNYCSGYL

SEQ ID NO: 3287 - protein, 18 aa, Artificial Sequence
  ErbB2 binding MRD
WSGWCEQDQKWNYCSGYI

SEQ ID NO: 3288 - protein, 18 aa, Artificial Sequence
  ErbB2 binding MRD
WSGWCFYEVRWGHCHGSI

SEQ ID NO: 3289 - protein, 18 aa, Artificial Sequence
  ErbB2 binding MRD
WSGYCLSESGWGHCGGLL

SEQ ID NO: 3290 - protein, 18 aa, Artificial Sequence
  ErbB2 binding MRD
WSGWCLSYSGWGHCSGSP

SEQ ID NO: 3291 - protein, 18 aa, Artificial Sequence
  ErbB2 binding MRD
WSGWCFYGDYWGHCSGQP

SEQ ID NO: 3292 - protein, 18 aa, Artificial Sequence
  ErbB2 binding MRD
WSGWCFKITGWGHCSGLI

SEQ ID NO: 3293 - protein, 18 aa, Artificial Sequence
  ErbB2 binding MRD
WSGWCENELQWSFCSGHI

SEQ ID NO: 3294 - protein, 18 aa, Artificial Sequence
  ErbB2 binding MRD
WSGWCEGERQWSFCSGSI

SEQ ID NO: 3295 - protein, 18 aa, Artificial Sequence
  ErbB2 binding MRD
WSGWCEYEFKWSFCSGHI

SEQ ID NO: 3296 - protein, 18 aa, Artificial Sequence
  ErbB2 binding MRD
WSGWCEHEMYWSYCSGHK

SEQ ID NO: 3297 - protein, 18 aa, Artificial Sequence
  ErbB2 binding MRD
WSGWCEGELRWFFCSGTL

SEQ ID NO: 3298 - protein, 18 aa, Artificial Sequence
  ErbB2 binding MRD
WSGWCFYGTHWGHCGGLP

SEQ ID NO: 3299 - protein, 18 aa, Artificial Sequence
  ErbB2 binding MRD
WSGWCFDGGRWGYCSGPL

SEQ ID NO: 3300 - protein, 18 aa, Artificial Sequence
  ErbB2 binding MRD
WSGWCLKGDGWGHCWGLI

SEQ ID NO: 3301 - protein, 18 aa, Artificial Sequence
  ErbB2 binding MRD
WSGWCLRVSGWDHCSGHP

SEQ ID NO: 3302 - protein, 19 aa, Artificial Sequence
  ErbB2 binding MRD
TDSWCHTLYWALQHCVAQE

SEQ ID NO: 3303 - protein, 18 aa, Artificial Sequence
  ErbB2 binding MRD
WSGWCLMGDSWGHCSGLI

SEQ ID NO: 3304 - protein, 18 aa, Artificial Sequence
  ErbB2 binding MRD
WSGWCEGEVGWFFCSGYL

SEQ ID NO: 3305 - protein, 18 aa, Artificial Sequence
  ErbB2 binding MRD
WSGWCEYELQWSFCFGPS

SEQ ID NO: 3306 - protein, 19 aa, Artificial Sequence
  ErbB2 binding MRD
PDSSCHTLYWQLHHCARRE

SEQ ID NO: 3307 - protein, 18 aa, Artificial Sequence
  ErbB2 binding MRD
WSGWCEGDLQWYYCSGHI

SEQ ID NO: 3308 - protein, 18 aa, Artificial Sequence
  ErbB2 binding MRD
WSGWCEEALRWSYCSGHI

SEQ ID NO: 3309 - protein, 18 aa, Artificial Sequence
  ErbB2 binding MRD
WSGWCLGDAGWGHCGGLP

SEQ ID NO: 3310 - protein, 18 aa, Artificial Sequence
  ErbB2 binding MRD
WSGWCFFDTHWGHCSGLL

SEQ ID NO: 3311 - protein, 18 aa, Artificial Sequence
  ErbB2 binding MRD
WSGWCFNHGAWGHCRGLI

SEQ ID NO: 3312 - protein, 18 aa, Artificial Sequence
  ErbB2 binding MRD
WSGWCYEHTGWRHCHGLI

SEQ ID NO: 3313 - protein, 18 aa, Artificial Sequence
  ErbB2 binding MRD
WSGWCLTREGWGHCKGLI

SEQ ID NO: 3314 - protein, 18 aa, Artificial Sequence
  ErbB2 binding MRD
WSGWCLSGVGWFHCKGMI

SEQ ID NO: 3315 - protein, 18 aa, Artificial Sequence
  ErbB2 binding MRD
WSGWCEGESQWFFCSGLI

SEQ ID NO: 3316 - protein, 18 aa, Artificial Sequence
  ErbB2 binding MRD
WSGWCEYESHWSFCSGHI

SEQ ID NO: 3317 - protein, 18 aa, Artificial Sequence
  ErbB2 binding MRD
WSGWCEGERKWSYCSGQI

SEQ ID NO: 3318 - protein, 18 aa, Artificial Sequence
  ErbB2 binding MRD
WSGWCEGELHWYSCSGHM

SEQ ID NO: 3319 - protein, 19 aa, Artificial Sequence
  ErbB2 binding MRD
PDSWCHTLYWDLLYCVNQE

SEQ ID NO: 3320 - protein, 18 aa, Artificial Sequence
  ErbB2 binding MRD
WSGWCETPCGWESCHGTI

SEQ ID NO: 3321 - protein, 18 aa, Artificial Sequence
  ErbB2 binding MRD
WSGWCESTDSWHFCRGNI

SEQ ID NO: 3322 - protein, 18 aa, Artificial Sequence
  ErbB2 binding MRD
WSGWCETPSGWKACRGNI

SEQ ID NO: 3323 - protein, 18 aa, Artificial Sequence
  ErbB2 binding MRD
WSGWCETGVGWHECHGTI

SEQ ID NO: 3324 - protein, 18 aa, Artificial Sequence
  ErbB2 binding MRD
WSGWCEAERQWTFCSGHI

SEQ ID NO: 3325 - protein, 18 aa, Artificial Sequence
  ErbB2 binding MRD
WSGWCENSEGWDFCNGTI

SEQ ID NO: 3326 - protein, 18 aa, Artificial Sequence
  ErbB2 binding MRD
WSGWCETQKGWHSCHGSI

SEQ ID NO: 3327 - protein, 18 aa, Artificial Sequence
  ErbB2 binding MRD
WSGWCLTGTDWHFCRGFI

SEQ ID NO: 3328 - protein, 18 aa, Artificial Sequence
  ErbB2 binding MRD
WSGWCETYKGWHACHGKI

SEQ ID NO: 3329 - protein, 18 aa, Artificial Sequence
  ErbB2 binding MRD
WSGWCETNAGWIQCYGSI

SEQ ID NO: 3330 - protein, 18 aa, Artificial Sequence
  ErbB2 binding MRD
WSGWCQTGANWHYCNGTI

SEQ ID NO: 3331 - protein, 18 aa, Artificial Sequence
  ErbB2 binding MRD
WSGWCLADGMWGHCNGTI

SEQ ID NO: 3332 - protein, 18 aa, Artificial Sequence
  ErbB2 binding MRD
WSGWCEGRDAWYQCKGTI

SEQ ID NO: 3333 - protein, 18 aa, Artificial Sequence
  ErbB2 binding MRD
WSGYCLTDGTWHHCKGTI

SEQ ID NO: 3334 - protein, 18 aa, Artificial Sequence
  ErbB2 binding MRD
WSGWCKTGKKWHHCGGTI

SEQ ID NO: 3335 - protein, 18 aa, Artificial Sequence
  ErbB2 binding MRD
WSGWCETSSGWHQCSGII

SEQ ID NO: 3336 - protein, 18 aa, Artificial Sequence
  ErbB2 binding MRD
WSGWCEEKGQWVSCGGSL

SEQ ID NO: 3337 - protein, 18 aa, Artificial Sequence
  ErbB2 binding MRD
WSGWCEGELQWYFCSGHL

SEQ ID NO: 3338 - protein, 18 aa, Artificial Sequence
  ErbB2 binding MRD
WSGWCEGEHKWSFCSGHL

SEQ ID NO: 3339 - protein, 18 aa, Artificial Sequence
  ErbB2 binding MRD
WSGWCESDKGWYQCRGTI

SEQ ID NO: 3340 - protein, 18 aa, Artificial Sequence
  ErbB2 binding MRD
YEEHCRLFPADWICSLLQ

SEQ ID NO: 3341 - protein, 18 aa, Artificial Sequence
  ErbB2 binding MRD
WSGWCETPGHWYQCRGSI

SEQ ID NO: 3342 - protein, 19 aa, Artificial Sequence
  ErbB2 binding MRD
ADSWCHTLYWNLRHCEIQE

SEQ ID NO: 3343 - protein, 18 aa, Artificial Sequence
  ErbB2 binding MRD
WSGWCNSGGGWHQCRGTI

SEQ ID NO: 3344 - protein, 18 aa, Artificial Sequence
  ErbB2 binding MRD
WSGWCLTDNKWHSCIGTI

SEQ ID NO: 3345 - protein, 18 aa, Artificial Sequence
  ErbB2 binding MRD
WSGWCETDRGWHDCHGTI

SEQ ID NO: 3346 - protein, 18 aa, Artificial Sequence
  ErbB2 binding MRD
WSGWCETKDHWHACNGII

SEQ ID NO: 3347 - protein, 18 aa, Artificial Sequence
  ErbB2 binding MRD
WSGWCEGELQWYFCSGKI

SEQ ID NO: 3348 - protein, 19 aa, Artificial Sequence
  ErbB2 binding MRD
PESWCHTLYWNLQHCLSQE

SEQ ID NO: 3349 - protein, 18 aa, Artificial Sequence
  ErbB2 binding MRD
WSGWCETSGGWHYCKGTI

SEQ ID NO: 3350 - protein, 18 aa, Artificial Sequence
  ErbB2 binding MRD
WSGWCETDQGWHHCWGTI

SEQ ID NO: 3351 - protein, 18 aa, Artificial Sequence
  ErbB2 binding MRD
WSGWCETKFGWNYCKGSI

SEQ ID NO: 3352 - protein, 18 aa, Artificial Sequence
  ErbB2 binding MRD
WSGWCFATSGWHSCRGTA

SEQ ID NO: 3353 - protein, 18 aa, Artificial Sequence
  ErbB2 binding MRD
WSGWCETGNGWDRCWGNI

SEQ ID NO: 3354 - protein, 18 aa, Artificial Sequence
  ErbB2 binding MRD
WSGWCEGQLQWFFCSGQI

SEQ ID NO: 3355 - protein, 18 aa, Artificial Sequence
  ErbB2 binding MRD
WSGWCERSWGWEQCRGTI

SEQ ID NO: 3356 - protein, 18 aa, Artificial Sequence
  ErbB2 binding MRD
WSGWCEYEEKWAFCSGYI

SEQ ID NO: 3357 - protein, 18 aa, Artificial Sequence
  ErbB2 binding MRD
WSGYCEGELQWYFCTGHL

SEQ ID NO: 3358 - protein, 18 aa, Artificial Sequence
  ErbB2 binding MRD
WSGWCETSVGWHKCSGTI

SEQ ID NO: 3359 - protein, 18 aa, Artificial Sequence
  ErbB2 binding MRD
WSGWCRIETGWDFCSGTI

SEQ ID NO: 3360 - protein, 18 aa, Artificial Sequence
  ErbB2 binding MRD
WSGWCETSKGWHFCSGTI

SEQ ID NO: 3361 - protein, 18 aa, Artificial Sequence
  ErbB2 binding MRD
WSGWCESSHGWHGCKGII

SEQ ID NO: 3362 - protein, 18 aa, Artificial Sequence
  ErbB2 binding MRD
WSGWCEYNGYWDYCTGTI

SEQ ID NO: 3363 - protein, 18 aa, Artificial Sequence
  ErbB2 binding MRD
WSGWCETGKYWHYCSGTI

SEQ ID NO: 3364 - protein, 18 aa, Artificial Sequence
  ErbB2 binding MRD
WSGWCEGKHQWYFCSGNL

SEQ ID NO: 3365 - protein, 18 aa, Artificial Sequence
  ErbB2 binding MRD
WSGWCETELGWHQCRGTI

SEQ ID NO: 3366 - protein, 18 aa, Artificial Sequence
  ErbB2 binding MRD
WSGWCEGQTKWYFCSGQI

SEQ ID NO: 3367 - protein, 18 aa, Artificial Sequence
  ErbB2 binding MRD
WSGWCLFDSKWDYCQGNI

SEQ ID NO: 3368 - protein, 19 aa, Artificial Sequence
  ErbB2 binding MRD
ANSWCHTLYWDLMYCVWQE

SEQ ID NO: 3369 - protein, 18 aa, Artificial Sequence
  ErbB2 binding MRD
WSGWCQTGMRWHQCYGTI

SEQ ID NO: 3370 - protein, 18 aa, Artificial Sequence
  ErbB2 binding MRD
WSGWCESNGTWHGCKGTI

SEQ ID NO: 3371 - protein, 18 aa, Artificial Sequence
  ErbB2 binding MRD
WSGWCEGKHGWYSCRGTI

SEQ ID NO: 3372 - protein, 18 aa, Artificial Sequence
  ErbB2 binding MRD
WSGWCETLSGWHQCHGVI

SEQ ID NO: 3373 - protein, 18 aa, Artificial Sequence
  ErbB2 binding MRD
WSGWCEGKEKWHHCNGSI

SEQ ID NO: 3374 - protein, 18 aa, Artificial Sequence
  ErbB2 binding MRD
WSGWCETSEGWHSCYGSI

SEQ ID NO: 3375 - protein, 18 aa, Artificial Sequence
  ErbB2 binding MRD
WSGWCLNELGWQQCFGTI

SEQ ID NO: 3376 - protein, 18 aa, Artificial Sequence
  ErbB2 binding MRD
WSGWCERVSGWNYCHGTI

SEQ ID NO: 3377 - protein, 18 aa, Artificial Sequence
  ErbB2 binding MRD
WSGWCYAPTGWHHCVGTI

SEQ ID NO: 3378 - protein, 18 aa, Artificial Sequence
  ErbB2 binding MRD
WSGWCETGTGWYHCGGTI

SEQ ID NO: 3379 - protein, 19 aa, Artificial Sequence
  ErbB2 binding MRD
PDSWCHTLYWHLQHCLSQE

SEQ ID NO: 3380 - protein, 18 aa, Artificial Sequence
  ErbB2 binding MRD
WSGWCEYELRWDFCSGHI

SEQ ID NO: 3381 - protein, 18 aa, Artificial Sequence
  ErbB2 binding MRD
WSGWCETVNGWHQCTGTI

SEQ ID NO: 3382 - protein, 18 aa, Artificial Sequence
  ErbB2 binding MRD
WSGWCLTKNSWDFCSGTI

SEQ ID NO: 3383 - protein, 18 aa, Artificial Sequence
  ErbB2 binding MRD
WSGWCLTNGVWHGCRGII

SEQ ID NO: 3384 - protein, 18 aa, Artificial Sequence
  ErbB2 binding MRD
WSGFCLTEESWHHCTGPI

SEQ ID NO: 3385 - protein, 18 aa, Artificial Sequence
  ErbB2 binding MRD
WSGWCEAIDMWYQCHGPI

SEQ ID NO: 3386 - protein, 18 aa, Artificial Sequence
  ErbB2 binding MRD
WSGWCFTGDLWHACTGII

SEQ ID NO: 3387 - protein, 18 aa, Artificial Sequence
  ErbB2 binding MRD
WSGWCEGELQWYYCSGKI

SEQ ID NO: 3388 - protein, 18 aa, Artificial Sequence
  ErbB2 binding MRD
WSGWCEGEFQWYFCSGQF

SEQ ID NO: 3389 - protein, 18 aa, Artificial Sequence
  ErbB2 binding MRD
WSGWCETNGKWDFCQGTI

SEQ ID NO: 3390 - protein, 18 aa, Artificial Sequence
  ErbB2 binding MRD
WSGWCETPVGWEQCTGTI

SEQ ID NO: 3391 - protein, 18 aa, Artificial Sequence
  ErbB2 binding MRD
WSGWCEGKLHWYFCSGHM

SEQ ID NO: 3392 - protein, 18 aa, Artificial Sequence
  ErbB2 binding MRD
WSGWCEGALGWSSCSGHG

SEQ ID NO: 3393 - protein, 17 aa, Artificial Sequence
  ErbB2 binding MRD
YEEHCALFPTDWICTLH

SEQ ID NO: 3394 - protein, 18 aa, Artificial Sequence
  ErbB2 binding MRD
WSGWCEGIGAWHFCKGII

SEQ ID NO: 3395 - protein, 18 aa, Artificial Sequence
  ErbB2 binding MRD
WSGWCESNDGWYQCKGDI

SEQ ID NO: 3396 - protein, 18 aa, Artificial Sequence
  ErbB2 binding MRD
WSGWCETLNGWYGCHGTM

SEQ ID NO: 3397 - protein, 18 aa, Artificial Sequence
  ErbB2 binding MRD
WSGWCENNDGWHHCHGSI

SEQ ID NO: 3398 - protein, 18 aa, Artificial Sequence
  ErbB2 binding MRD
WSGYCETGRGWHMCQGTI

SEQ ID NO: 3399 - protein, 18 aa, Artificial Sequence
  ErbB2 binding MRD
WSGWCETVTGWDYCNGKI

SEQ ID NO: 3400 - protein, 18 aa, Artificial Sequence
  ErbB2 binding MRD
WSGWCETDEGWRQCSGTI

SEQ ID NO: 3401 - protein, 18 aa, Artificial Sequence
  ErbB2 binding MRD
WSGWCMTLDKWHQCYGTI

SEQ ID NO: 3402 - protein, 18 aa, Artificial Sequence
  ErbB2 binding MRD
WSGWCETNNGWYACWGMI

SEQ ID NO: 3403 - protein, 18 aa, Artificial Sequence
  ErbB2 binding MRD
WSGWCFNEAGWGHCYGLP

SEQ ID NO: 3404 - protein, 18 aa, Artificial Sequence
  ErbB2 binding MRD
WSGWCETDRGWHECHGTI

SEQ ID NO: 3405 - protein, 18 aa, Artificial Sequence
  ErbB2 binding MRD
WSGWCETKFGWSYCKGTI

SEQ ID NO: 3406 - protein, 18 aa, Artificial Sequence
  ErbB2 binding MRD
WSGWCEGEDGWHSCRGTI

SEQ ID NO: 3407 - protein, 18 aa, Artificial Sequence
  ErbB2 binding MRD
WSGWCETSKGWHFCSGII

SEQ ID NO: 3408 - protein, 20 aa, Artificial Sequence
  ErbB2 binding MRD
PKYSCVYSIMKEKWHCRAQT

SEQ ID NO: 3409 - protein, 18 aa, Artificial Sequence
  ErbB2 binding MRD
FKPHCVYKHQTWVCGPPA

SEQ ID NO: 3410 - protein, 18 aa, Artificial Sequence
  ErbB2 binding MRD
THMHCYQHKHHYHCRTSL

SEQ ID NO: 3411 - protein, 18 aa, Artificial Sequence
  ErbB2 binding MRD
GPELCHHMAGHEWCLRYY

SEQ ID NO: 3412 - protein, 18 aa, Artificial Sequence
  ErbB2 binding MRD
HRSKCFMMYWDENCLQPW

SEQ ID NO: 3413 - protein, 17 aa, Artificial Sequence
  ErbB2 binding MRD
LGGRCMLFALKQCSMGH

SEQ ID NO: 3414 - protein, 17 aa, Artificial Sequence
  ErbB2 binding MRD
WSRLCTMRLPSTCGVWE

SEQ ID NO: 3415 - protein, 19 aa, Artificial Sequence
  ErbB2 binding MRD
RSWHCSHQMGSKPHCVLSP

SEQ ID NO: 3416 - protein, 18 aa, Artificial Sequence
  ErbB2 binding MRD
TWFRCTPHKHHYHCKHNV

SEQ ID NO: 3417 - protein, 20 aa, Artificial Sequence
  ErbB2 binding MRD
GIWICRHDSPYMKPHCIFTS

SEQ ID NO: 3418 - protein, 18 aa, Artificial Sequence
  ErbB2 binding MRD
TWSKCFMVPLGDYCTRAL

SEQ ID NO: 3419 - protein, 20 aa, Artificial Sequence
  ErbB2 binding MRD
SVWKCVKHPFKIKPLCKLES

SEQ ID NO: 3420 - protein, 19 aa, Artificial Sequence
  ErbB2 binding MRD
RTWFCEKMHGQKFHCVSWF

SEQ ID NO: 3421 - protein, 19 aa, Artificial Sequence
  ErbB2 binding MRD
ADSWCHTLFWQLQHCVWQE

SEQ ID NO: 3422 - protein, 17 aa, Artificial Sequence
  ErbB2 binding MRD
KWRCCYGQFQPACNAVS

SEQ ID NO: 3423 - protein, 20 aa, Artificial Sequence
  ErbB2 binding MRD
PRYKCVFNWEVQKWQCSVWS

SEQ ID NO: 3424 - protein, 18 aa, Artificial Sequence
  ErbB2 binding MRD
PNRYCYTYPHSVKCAWMY

SEQ ID NO: 3425 - protein, 19 aa, Artificial Sequence
  ErbB2 binding MRD
DPSRCSKAYQMLYQCRTLI

SEQ ID NO: 3426 - protein, 18 aa, Artificial Sequence
  ErbB2 binding MRD
STDLCWPHKKHWHCPPAN

SEQ ID NO: 3427 - protein, 20 aa, Artificial Sequence
  ErbB2 binding MRD
SAWYCTKHMPQSKYHCISMR

SEQ ID NO: 3428 - protein, 16 aa, Artificial Sequence
  ErbB2 binding MRD
KWWKCGVIFEICQIVP

SEQ ID NO: 3429 - protein, 16 aa, Artificial Sequence
  ErbB2 binding MRD
AQLKCFEKLYMCRHHL

SEQ ID NO: 3430 - protein, 16 aa, Artificial Sequence
  ErbB2 binding MRD
VDRVCQFFMQKCWSSP

SEQ ID NO: 3431 - protein, 18 aa, Artificial Sequence
  ErbB2 binding MRD
KWTRCIPRMETHTCDCLL

SEQ ID NO: 3432 - protein, 18 aa, Artificial Sequence
  ErbB2 binding MRD
KLPQCLWEWDNRDCRWLL

SEQ ID NO: 3433 - protein, 16 aa, Artificial Sequence
  ErbB2 binding MRD
LHRFCDHFAIQCRFCN

SEQ ID NO: 3434 - protein, 16 aa, Artificial Sequence
  ErbB2 binding MRD
LICKQHKNHWHCRNYY

SEQ ID NO: 3435 - protein, 20 aa, Artificial Sequence
  ErbB2 binding MRD
KPWKCFYSYKIQHWKCHGVS

SEQ ID NO: 3436 - protein, 19 aa, Artificial Sequence
  ErbB2 binding MRD
TDSWCHTLYWQLHHCAILE

SEQ ID NO: 3437 - protein, 17 aa, Artificial Sequence
  ErbB2 binding MRD
KWRCCYGQFQQACNAVS

SEQ ID NO: 3438 - protein, 20 aa, Artificial Sequence
  ErbB2 binding MRD
WTHACVVWNMKQMEACTSLT

SEQ ID NO: 3439 - protein, 17 aa, Artificial Sequence
  ErbB2 binding MRD
LLNQCLQWAFHNCGCWN

SEQ ID NO: 3440 - protein, 18 aa, Artificial Sequence
  ErbB2 binding MRD
WSGYCELKDRWAYCSGSI

SEQ ID NO: 3441 - protein, 19 aa, Artificial Sequence
  ErbB2 binding MRD
HRAPCFSCTACRQPCFSLT

SEQ ID NO: 3442 - protein, 18 aa, Artificial Sequence
  ErbB2 binding MRD
WSGYCEMKGYWAHCTGLI

SEQ ID NO: 3443 - protein, 18 aa, Artificial Sequence
  ErbB2 binding MRD
WSGYCEFLDHWDHCSGGE

SEQ ID NO: 3444 - protein, 18 aa, Artificial Sequence
  ErbB2 binding MRD
WSGYCEYKDHWDHCGSSV

SEQ ID NO: 3445 - protein, 18 aa, Artificial Sequence
  ErbB2 binding MRD
WSGYCEYKDHWDYCGSSV

SEQ ID NO: 3446 - protein, 18 aa, Artificial Sequence
  ErbB2 binding MRD
WSGYCEYKDHWDFCGNVD

SEQ ID NO: 3447 - protein, 18 aa, Artificial Sequence
  ErbB2 binding MRD
WSGYCEYRDHWAHCGGSL

SEQ ID NO: 3448 - protein, 18 aa, Artificial Sequence
  ErbB2 binding MRD
WSGYCEFEGYWAHCGGSI

SEQ ID NO: 3449 - protein, 18 aa, Artificial Sequence
  ErbB2 binding MRD
WSGYCEYIDHWGYCQGSI

SEQ ID NO: 3450 - protein, 18 aa, Artificial Sequence
  ErbB2 binding MRD
WSGYCEMNDHWDYCYGSI

SEQ ID NO: 3451 - protein, 18 aa, Artificial Sequence
  ErbB2 binding MRD
WSGYCEYKDHWGYCGGSI

SEQ ID NO: 3452 - protein, 18 aa, Artificial Sequence
  ErbB2 binding MRD
WSGYCQLMDHWDYCHGQG

SEQ ID NO: 3453 - protein, 18 aa, Artificial Sequence
  ErbB2 binding MRD
WSGYCEMTDHWAHCSGSH

SEQ ID NO: 3454 - protein, 18 aa, Artificial Sequence
  ErbB2 binding MRD
WSGYCEFEDHWDYCHGSV

SEQ ID NO: 3455 - protein, 18 aa, Artificial Sequence
  ErbB2 binding MRD
WSGYCEMKDHWAHCGGLI

SEQ ID NO: 3456 - protein, 18 aa, Artificial Sequence
  ErbB2 binding MRD
WSGYCEFKDHWDYCHGSV

SEQ ID NO: 3457 - protein, 18 aa, Artificial Sequence
  ErbB2 binding MRD
WSGYCEMGDHWDYCSGSV

SEQ ID NO: 3458 - protein, 18 aa, Artificial Sequence
  ErbB2 binding MRD
WSGYCEFNGFWAHCGGFI

SEQ ID NO: 3459 - protein, 18 aa, Artificial Sequence
  ErbB2 binding MRD
WSGYCLMKDHWGYCGGWI

SEQ ID NO: 3460 - protein, 18 aa, Artificial Sequence
  ErbB2 binding MRD
WSGYCEFEDHWDYCGNSE

SEQ ID NO: 3461 - protein, 18 aa, Artificial Sequence
  ErbB2 binding MRD
FQGHCALFPTDWICTLKS

SEQ ID NO: 3462 - protein, 18 aa, Artificial Sequence
  ErbB2 binding MRD
WSGYCEFKTHWGHCGNPQ

SEQ ID NO: 3463 - protein, 18 aa, Artificial Sequence
  ErbB2 binding MRD
WSGYCEFKDHWDHCHSSG

SEQ ID NO: 3464 - protein, 18 aa, Artificial Sequence
  ErbB2 binding MRD
WSGYCEKEGYWAHCRGTI

SEQ ID NO: 3465 - protein, 18 aa, Artificial Sequence
  ErbB2 binding MRD
WSGYCEMKGHWAHCGGSP

SEQ ID NO: 3466 - protein, 18 aa, Artificial Sequence
  ErbB2 binding MRD
WSGYCNMGDHWDHCSGSI

SEQ ID NO: 3467 - protein, 18 aa, Artificial Sequence
  ErbB2 binding MRD
WSGYCEFKDHWAHCSGSL

SEQ ID NO: 3468 - protein, 18 aa, Artificial Sequence
  ErbB2 binding MRD
WSGYCEMKGYWDFCGGLI

SEQ ID NO: 3469 - protein, 18 aa, Artificial Sequence
  ErbB2 binding MRD
WSGYCEFQDYWDYCGGSI

SEQ ID NO: 3470 - protein, 18 aa, Artificial Sequence
  ErbB2 binding MRD
WSGYCEMEHGWDYCSGTI

SEQ ID NO: 3471 - protein, 18 aa, Artificial Sequence
  ErbB2 binding MRD
WSGYCEFKDHWDHCGDSE

SEQ ID NO: 3472 - protein, 18 aa, Artificial Sequence
  ErbB2 binding MRD
WSGYCELEDHWAFCGGTI

SEQ ID NO: 3473 - protein, 18 aa, Artificial Sequence
  ErbB2 binding MRD
WSGYCEFKGYWDFCYGSM

SEQ ID NO: 3474 - protein, 18 aa, Artificial Sequence
  ErbB2 binding MRD
WSGYCEGQYFWYHCSGSG

SEQ ID NO: 3475 - protein, 18 aa, Artificial Sequence
  ErbB2 binding MRD
WSGYCEFQDHWDHCFGSS

SEQ ID NO: 3476 - protein, 18 aa, Artificial Sequence
  ErbB2 binding MRD
WSGYCEMNDHWDYCYGPK

SEQ ID NO: 3477 - protein, 18 aa, Artificial Sequence
  ErbB2 binding MRD
WSGYCEFRDHWDYCGNSY

SEQ ID NO: 3478 - protein, 18 aa, Artificial Sequence
  ErbB2 binding MRD
WSGYCEFKDHWDYCGNSD

SEQ ID NO: 3479 - protein, 18 aa, Artificial Sequence
  ErbB2 binding MRD
WSGYCEFKDHWDFCGGSY

SEQ ID NO: 3480 - protein, 18 aa, Artificial Sequence
  ErbB2 binding MRD
WSGYCQTNDHWDYCSGTI

SEQ ID NO: 3481 - protein, 18 aa, Artificial Sequence
  ErbB2 binding MRD
WSGYCESYDHWYHCGGTL

SEQ ID NO: 3482 - protein, 18 aa, Artificial Sequence
  ErbB2 binding MRD
WSGYCEYEDHWDYCGTWV

SEQ ID NO: 3483 - protein, 18 aa, Artificial Sequence
  ErbB2 binding MRD
WSGYCEMEDRWAYCSGSI

SEQ ID NO: 3484 - protein, 18 aa, Artificial Sequence
  ErbB2 binding MRD
WSGYCEFKDHWDHCGGSL

SEQ ID NO: 3485 - protein, 18 aa, Artificial Sequence
  ErbB2 binding MRD
WSGYCQMKDHWDYCSGSL

SEQ ID NO: 3486 - protein, 18 aa, Artificial Sequence
  ErbB2 binding MRD
WSGYCEGKEHWYQCGGPL

SEQ ID NO: 3487 - protein, 18 aa, Artificial Sequence
  ErbB2 binding MRD
WSGYCEFNDHWAHCHGSP

SEQ ID NO: 3488 - protein, 18 aa, Artificial Sequence
  ErbB2 binding MRD
WSGYCEFKDRWAHCSGSI

SEQ ID NO: 3489 - protein, 18 aa, Artificial Sequence
  ErbB2 binding MRD
WSGYCEFKGYWDHCGSSK

SEQ ID NO: 3490 - protein, 18 aa, Artificial Sequence
  ErbB2 binding MRD
WSGYCEYKDRWAHCRGTM

SEQ ID NO: 3491 - protein, 18 aa, Artificial Sequence
  ErbB2 binding MRD
WSGYCEFKDHWDYCGGSY

SEQ ID NO: 3492 - protein, 18 aa, Artificial Sequence
  ErbB2 binding MRD
WSGYCEMKDHWAHCSGSI

SEQ ID NO: 3493 - protein, 18 aa, Artificial Sequence
  ErbB2 binding MRD
WSGYCEYQDHWAHCGRSM

SEQ ID NO: 3494 - protein, 18 aa, Artificial Sequence
  ErbB2 binding MRD
WSGYCEFSDHWDHCGNSK

SEQ ID NO: 3495 - protein, 18 aa, Artificial Sequence
  ErbB2 binding MRD
WSGYCEMKDHWAHCGGSI

SEQ ID NO: 3496 - protein, 18 aa, Artificial Sequence
  EGB417
SAISCYVYQQHRHCDWDH

SEQ ID NO: 3497 - protein, 18 aa, Artificial Sequence
  EGB390
WSGYCEMKDHWAHCGHSE

SEQ ID NO: 3498 - protein, 18 aa, Artificial Sequence
  EGB858
WSGYCETPSGWKACRGNI

SEQ ID NO: 3499 - protein, 15 aa, Artificial Sequence
  ErbB3 binding MRD
VYQLCIKMWVCTWHG

SEQ ID NO: 3500 - protein, 17 aa, Artificial Sequence
  ErbB3 binding MRD
DLVGCLLFSHVSCFSPL

SEQ ID NO: 3501 - protein, 16 aa, Artificial Sequence
  ErbB3 binding MRD
PTLSACMEAKCVLIFL

SEQ ID NO: 3502 - protein, 19 aa, Artificial Sequence
  ErbB3 binding MRD
LLWRCELMPPWPYMCSEVD

SEQ ID NO: 3503 - protein, 19 aa, Artificial Sequence
  ErbB3 binding MRD
GTQECAQDDYFRYWCLRTW

SEQ ID NO: 3504 - protein, 17 aa, Artificial Sequence
  ErbB3 binding MRD
LDLCMTIERPHRQCPCG

SEQ ID NO: 3505 - protein, 15 aa, Artificial Sequence
  ErbB3 binding MRD
LWRWCVWARDCPQSS

SEQ ID NO: 3506 - protein, 16 aa, Artificial Sequence
  ErbB3 binding MRD
IAREFCMNYQCLRLLR

SEQ ID NO: 3507 - protein, 15 aa, Artificial Sequence
  ErbB3 binding MRD
SYWVCLTYFICWPSW

SEQ ID NO: 3508 - protein, 19 aa, Artificial Sequence
  ErbB3 binding MRD
VQQFVHWMESWNPACFWRM

SEQ ID NO: 3509 - protein, 17 aa, Artificial Sequence
  ErbB3 binding MRD
LLNQCLQWAFHNCGCWN

SEQ ID NO: 3510 - protein, 20 aa, Artificial Sequence
  ErbB3 binding MRD
LSWWCRMGWFQEYGECNFLF

SEQ ID NO: 3511 - protein, 20 aa, Artificial Sequence
  ErbB3 binding MRD
WTHACVVWNMKQMEACTSLT

SEQ ID NO: 3512 - protein, 16 aa, Artificial Sequence
  ErbB3 binding MRD
KVMFCWVMWKQCSSPP

SEQ ID NO: 3513 - protein, 20 aa, Artificial Sequence
  ErbB3 binding MRD
SLVSCPVHNPIWWSHCMEIM

SEQ ID NO: 3514 - protein, 20 aa, Artificial Sequence
  ErbB3 binding MRD
GHRLCIWMQNFVDGHCAGLV

SEQ ID NO: 3515 - protein, 20 aa, Artificial Sequence
  ErbB3 binding MRD
CHVSCPFYNPNWWSHCMELM

SEQ ID NO: 3516 - protein, 20 aa, Artificial Sequence
  ErbB3 binding MRD
FLEMCMDWNPKTWCYCMEWM

SEQ ID NO: 3517 - protein, 20 aa, Artificial Sequence
  ErbB3 binding MRD
SFVMCPVYNPKQWSVCMEIL

SEQ ID NO: 3518 - protein, 20 aa, Artificial Sequence
  ErbB3 binding MRD
LFLMCLVYPSEKWHVCVETL

SEQ ID NO: 3519 - protein, 20 aa, Artificial Sequence
  ErbB3 binding MRD
SLVKCPFFNPIWWSHCMELM

SEQ ID NO: 3520 - protein, 20 aa, Artificial Sequence
  ErbB3 binding MRD
WSHACIVYNDKIMGACTCLT

SEQ ID NO: 3521 - protein, 20 aa, Artificial Sequence
  ErbB3 binding MRD
DQVRCPFQNPVWWSHCMYLL

SEQ ID NO: 3522 - protein, 20 aa, Artificial Sequence
  ErbB3 binding MRD
PLERCPFQNPLWFSHCMEML

SEQ ID NO: 3523 - protein, 20 aa, Artificial Sequence
  ErbB3 binding MRD
KFFMCQVYPSNRWAVCVETL

SEQ ID NO: 3524 - protein, 20 aa, Artificial Sequence
  ErbB3 binding MRD
TFYVCQIYPSGKWHVCVGTC

SEQ ID NO: 3525 - protein, 20 aa, Artificial Sequence
  ErbB3 binding MRD
RFFMCQVYPSYKWHVCVESW

SEQ ID NO: 3526 - protein, 20 aa, Artificial Sequence
  ErbB3 binding MRD
KFLMCRLYPSGKWHVCVETL

SEQ ID NO: 3527 - protein, 20 aa, Artificial Sequence
  ErbB3 binding MRD
LEVYCPFENPIWWARCMELM

SEQ ID NO: 3528 - protein, 20 aa, Artificial Sequence
  ErbB3 binding MRD
SRVRCPFQNPIWLAHCMKMT

SEQ ID NO: 3529 - protein, 20 aa, Artificial Sequence
  ErbB3 binding MRD
SQVRCPFQNPIWRNHCMELI

SEQ ID NO: 3530 - protein, 20 aa, Artificial Sequence
  ErbB3 binding MRD
PKVRCPFQNPIWWSHCMEML

SEQ ID NO: 3531 - protein, 20 aa, Artificial Sequence
  ErbB3 binding MRD
NFVMCQVYPSYTWHVCVGTL

SEQ ID NO: 3532 - protein, 20 aa, Artificial Sequence
  ErbB3 binding MRD
KFMICRLYPSGNLHICVETS

SEQ ID NO: 3533 - protein, 20 aa, Artificial Sequence
  ErbB3 binding MRD
TFMMCQVYPSLKWHVCIETG

SEQ ID NO: 3534 - protein, 20 aa, Artificial Sequence
  ErbB3 binding MRD
RFVMCQVYPSLNWHVCVQTL

SEQ ID NO: 3535 - protein, 20 aa, Artificial Sequence
  ErbB3 binding MRD
SPVRCPFQNPIWYAHCMKIT

SEQ ID NO: 3536 - protein, 20 aa, Artificial Sequence
  ErbB3 binding MRD
SKVYCPFQNPIWFAKCIELM

SEQ ID NO: 3537 - protein, 20 aa, Artificial Sequence
  ErbB3 binding MRD
PQVRCPFQNPIWYSHCMKLM

SEQ ID NO: 3538 - protein, 20 aa, Artificial Sequence
  ErbB3 binding MRD
TQVRCPFQNPIWWSHCMEML

SEQ ID NO: 3539 - protein, 20 aa, Artificial Sequence
  ErbB3 binding MRD
KLMLCQVYPSLKWHVCVEAS

SEQ ID NO: 3540 - protein, 20 aa, Artificial Sequence
  ErbB3 binding MRD
NFLMCQVYPSYKWHVCVEQL

SEQ ID NO: 3541 - protein, 20 aa, Artificial Sequence
  ErbB3 binding MRD
RFLVCQVYPSLKWHVCVEKS

SEQ ID NO: 3542 - protein, 20 aa, Artificial Sequence
  ErbB3 binding MRD
TFFICQVYPSGKWHVCVDTV

SEQ ID NO: 3543 - protein, 20 aa, Artificial Sequence
  ErbB3 binding MRD
GFIMCQVYPSENWHVCLDRG

SEQ ID NO: 3544 - protein, 20 aa, Artificial Sequence
  ErbB3 binding MRD
KFIMCQVYPSERWHVCLETM

SEQ ID NO: 3545 - protein, 20 aa, Artificial Sequence
  ErbB3 binding MRD
SDVYCPFSNPAWWVHCMEML

SEQ ID NO: 3546 - protein, 20 aa, Artificial Sequence
  ErbB3 binding MRD
TQVYCPFANPVWWNHCMLLS

SEQ ID NO: 3547 - protein, 20 aa, Artificial Sequence
  ErbB3 binding MRD
KFFMCQIYPSLKWHVCVEKL

SEQ ID NO: 3548 - protein, 20 aa, Artificial Sequence
  ErbB3 binding MRD
KFVMCQVYPSEKWHVCIAPL

SEQ ID NO: 3549 - protein, 20 aa, Artificial Sequence
  ErbB3 binding MRD
QFFMCQVYPSLRWSVCQVTL

SEQ ID NO: 3550 - protein, 20 aa, Artificial Sequence
  ErbB3 binding MRD
GFVMCQVYPSQKWHVCLDTF

SEQ ID NO: 3551 - protein, 20 aa, Artificial Sequence
  ErbB3 binding MRD
GFHMCQVYPSGKWLVCLHPR

SEQ ID NO: 3552 - protein, 20 aa, Artificial Sequence
  ErbB3 binding MRD
EFYMCQVYPSELWHVCVDKL

SEQ ID NO: 3553 - protein, 20 aa, Artificial Sequence
  ErbB3 binding MRD
FKERCPFQNPIWYSRCMELI

SEQ ID NO: 3554 - protein, 20 aa, Artificial Sequence
  ErbB3 binding MRD
SSVRCPFQNPIWWSHCMELL

SEQ ID NO: 3555 - protein, 20 aa, Artificial Sequence
  ErbB3 binding MRD
SEIRCPFKNPIWYAHCMKLI

SEQ ID NO: 3556 - protein, 20 aa, Artificial Sequence
  ErbB3 binding MRD
SQVRCPFQNPIWYTHCMELL

SEQ ID NO: 3557 - protein, 20 aa, Artificial Sequence
  ErbB3 binding MRD
SQVYCPFHNPIWLAHCMELM

SEQ ID NO: 3558 - protein, 20 aa, Artificial Sequence
  ErbB3 binding MRD
KFILCQVYPSGKWHICTETL

SEQ ID NO: 3559 - protein, 20 aa, Artificial Sequence
  ErbB3 binding MRD
NLLLCKVYPSGKWHVCFAPL

SEQ ID NO: 3560 - protein, 20 aa, Artificial Sequence
  ErbB3 binding MRD
KFQLCQVYPSERWHICVVTL

SEQ ID NO: 3561 - protein, 20 aa, Artificial Sequence
  ErbB3 binding MRD
NFYMCKVYPSELWHVCVETL

SEQ ID NO: 3562 - protein, 20 aa, Artificial Sequence
  ErbB3 binding MRD
RFVMCQVYPSAKWHVCVETL

SEQ ID NO: 3563 - protein, 20 aa, Artificial Sequence
  ErbB3 binding MRD
TNIRCPFQNPIWYSHCIALT

SEQ ID NO: 3564 - protein, 20 aa, Artificial Sequence
  ErbB3 binding MRD
SPVRCPFQNPIWYEHCMALI

SEQ ID NO: 3565 - protein, 20 aa, Artificial Sequence
  ErbB3 binding MRD
SAVRCPFHNPIWYSHCMKLL

SEQ ID NO: 3566 - protein, 20 aa, Artificial Sequence
  ErbB3 binding MRD
AQVRCPFQNPVWYSHCMDLI

SEQ ID NO: 3567 - protein, 20 aa, Artificial Sequence
  ErbB3 binding MRD
YFRMCQVYPSLKWHICVETM

SEQ ID NO: 3568 - protein, 20 aa, Artificial Sequence
  ErbB3 binding MRD
GFFMCQVYPSEKWHVCLETL

SEQ ID NO: 3569 - protein, 20 aa, Artificial Sequence
  ErbB3 binding MRD
GFIMCQVYPSLKWHVCVETS

SEQ ID NO: 3570 - protein, 20 aa, Artificial Sequence
  ErbB3 binding MRD
KFFMCQIYPSEKWHVCVKLW

SEQ ID NO: 3571 - protein, 20 aa, Artificial Sequence
  ErbB3 binding MRD
AASLCPFQNPIWLAHCMEMM

SEQ ID NO: 3572 - protein, 20 aa, Artificial Sequence
  ErbB3 binding MRD
SKVYCPFQNPIWWSHCMELI

SEQ ID NO: 3573 - protein, 20 aa, Artificial Sequence
  ErbB3 binding MRD
SQAYCPFQNPIWWNHCMELI

SEQ ID NO: 3574 - protein, 20 aa, Artificial Sequence
  ErbB3 binding MRD
HLFLCQVYPSEKWHVCVETL

SEQ ID NO: 3575 - protein, 20 aa, Artificial Sequence
  ErbB3 binding MRD
KFRMCQVYPSGKWHVCAETF

SEQ ID NO: 3576 - protein, 20 aa, Artificial Sequence
  ErbB3 binding MRD
KFFLCQVYPSGKYHICVSTW

SEQ ID NO: 3577 - protein, 20 aa, Artificial Sequence
  ErbB3 binding MRD
KFYMCQVYPSVRWHVCVDTS

SEQ ID NO: 3578 - protein, 20 aa, Artificial Sequence
  ErbB3 binding MRD
TREICPFQNPIWRSHCLKLV

SEQ ID NO: 3579 - protein, 20 aa, Artificial Sequence
  ErbB3 binding MRD
PMVRCPFKNPVWYSHCLELL

SEQ ID NO: 3580 - protein, 20 aa, Artificial Sequence
  ErbB3 binding MRD
TFFMCQVYPSGKWHVCVGGL

SEQ ID NO: 3581 - protein, 20 aa, Artificial Sequence
  ErbB3 binding MRD
KFFLCQVYPSEKWHVCIERL

SEQ ID NO: 3582 - protein, 20 aa, Artificial Sequence
  ErbB3 binding MRD
RYQMCQVYPSGKWHVCMETI

SEQ ID NO: 3583 - protein, 20 aa, Artificial Sequence
  ErbB3 binding MRD
RFQMCKVYPSERWHVCVEIL

SEQ ID NO: 3584 - protein, 18 aa, Artificial Sequence
  ErbB3 binding MRD
WCTECMRRFPGHYCVAFC

SEQ ID NO: 3585 - protein, 16 aa, Artificial Sequence
  ErbB3 binding MRD
RAASCLDVFHWCHSWC

SEQ ID NO: 3586 - protein, 17 aa, Artificial Sequence
  ErbB3 binding MRD
CLSRCVDWVFSNCTSGR

SEQ ID NO: 3587 - protein, 18 aa, Artificial Sequence
  ErbB3 binding MRD
FLMLCHVSKYTIKCFSPL

SEQ ID NO: 3588 - protein, 18 aa, Artificial Sequence
  ErbB3 binding MRD
WALACSWTPRWHQCIFSL

SEQ ID NO: 3589 - protein, 17 aa, Artificial Sequence
  ErbB3 binding MRD
LERLCMEIFYVHCSGSI

SEQ ID NO: 3590 - protein, 19 aa, Artificial Sequence
  ErbB3 binding MRD
SWRMCIEMFLTHDECVRFV

SEQ ID NO: 3591 - protein, 18 aa, Artificial Sequence
  ErbB3 binding MRD
SSVVCVRGIHAWTCHFFV

SEQ ID NO: 3592 - protein, 16 aa, Artificial Sequence
  ErbB3 binding MRD
LTSSCVYVYNWCAVWA

SEQ ID NO: 3593 - protein, 16 aa, Artificial Sequence
  ErbB3 binding MRD
YRHLCVWLMEQCETAR

SEQ ID NO: 3594 - protein, 16 aa, Artificial Sequence
  ErbB3 binding MRD
RAASCLDVFHCRRSWS

SEQ ID NO: 3595 - protein, 15 aa, Artificial Sequence
  ErbB3 binding MRD
HVSICWGYTYCWQIF

SEQ ID NO: 3596 - protein, 16 aa, Artificial Sequence
  ErbB3 binding MRD
RGASCLDLFHWCHSWG

SEQ ID NO: 3597 - protein, 18 aa, Artificial Sequence
  ErbB3 binding MRD
IYILCTNFKPVFWCVFST

SEQ ID NO: 3598 - protein, 18 aa, Artificial Sequence
  ErbB3 binding MRD
LWIRCSLLQYSYYCSWVW

SEQ ID NO: 3599 - protein, 18 aa, Artificial Sequence
  ErbB3 binding MRD
SYLFCYTLYIDYNCWLWS

SEQ ID NO: 3600 - protein, 17 aa, Artificial Sequence
  ErbB3 binding MRD
PGYRCVFQVNYQCGAAF

SEQ ID NO: 3601 - protein, 19 aa, Artificial Sequence
  ErbB3 binding MRD
TIIRCFWTFHMDFVCVTGV

SEQ ID NO: 3602 - protein, 16 aa, Artificial Sequence
  ErbB3 binding MRD
WLNCGCVVITCIVEPR

SEQ ID NO: 3603 - protein, 18 aa, Artificial Sequence
  ErbB3 binding MRD
WGWRCYQSWSYQDCQYWY

SEQ ID NO: 3604 - protein, 18 aa, Artificial Sequence
  ErbB3 binding MRD
FLMLCRVSKYTIKCFSPL

SEQ ID NO: 3605 - protein, 18 aa, Artificial Sequence
  ErbB3 binding MRD
RGRDCLRSFPGHYCVTFR

SEQ ID NO: 3606 - protein, 20 aa, Artificial Sequence
  ErbB3 binding MRD
LNYICWRWAHQVPWQCSLFQ

SEQ ID NO: 3607 - protein, 18 aa, Artificial Sequence
  ErbB3 binding MRD
ASYSCWWGPMYMECWTKV

SEQ ID NO: 3608 - protein, 18 aa, Artificial Sequence
  ErbB3 binding MRD
KTGSCQAQKVFSWCAQWC

SEQ ID NO: 3609 - protein, 20 aa, Artificial Sequence
  ErbB3 binding MRD
KFFMCQVYPSLKWHVCMETL

SEQ ID NO: 3610 - protein, 20 aa, Artificial Sequence
  ErbB3 binding MRD
KFMMCQVYPSLKWHVCVETL

SEQ ID NO: 3611 - protein, 19 aa, Artificial Sequence
  ErbB3 binding MRD
VEHLCSKIPFWHVQCLARF

SEQ ID NO: 3612 - protein, 20 aa, Artificial Sequence
  ErbB3 binding MRD
KFLMCQVYPSLKWHVCMETL

SEQ ID NO: 3613 - protein, 20 aa, Artificial Sequence
  ErbB3 binding MRD
QFLMCQVYPSLKWHVCVETL

SEQ ID NO: 3614 - protein, 20 aa, Artificial Sequence
  ErbB3 binding MRD
QFMLCQVYPSKKWHVCVVPV

SEQ ID NO: 3615 - protein, 15 aa, Artificial Sequence
  ErbB3 binding MRD
GSCALKNRSKCARRG

SEQ ID NO: 3616 - protein, 20 aa, Artificial Sequence
  ErbB3 binding MRD
KFQMCQVYPSGNWHVCVETM

SEQ ID NO: 3617 - protein, 20 aa, Artificial Sequence
  ErbB3 binding MRD
RERTCVYFHKILHDFCPSRT

SEQ ID NO: 3618 - protein, 18 aa, Artificial Sequence
  ErbB3 binding MRD
FKFTCYWAPYHTFCNTGQ

SEQ ID NO: 3619 - protein, 20 aa, Artificial Sequence
  ErbB3 binding MRD
KFFMCQVYPSLKWHVWMETL

SEQ ID NO: 3620 - protein, 19 aa, Artificial Sequence
  ErbB3 binding MRD
KFQCARFTLPETGMFVSKL

SEQ ID NO: 3621 - protein, 19 aa, Artificial Sequence
  ErbB3 binding MRD
WYEQCMKRHHPQAFCLRFN

SEQ ID NO: 3622 - protein, 20 aa, Artificial Sequence
  ErbB3 binding MRD
KFLMCQVYPSKKWHVCIETL

SEQ ID NO: 3623 - protein, 20 aa, Artificial Sequence
  ErbB3 binding MRD
QFMLCQVYPSKKWHVCVVTV

SEQ ID NO: 3624 - protein, 18 aa, Artificial Sequence
  ErbB3 binding MRD
CLGSCMLKGFERWCIHGH

SEQ ID NO: 3625 - protein, 20 aa, Artificial Sequence
  ErbB3 binding MRD
KFFMCVDYPSLKWDVCMETL

SEQ ID NO: 3626 - protein, 20 aa, Artificial Sequence
  ErbB3 binding MRD
RFFMCVDYPSIKWDVCPETI

SEQ ID NO: 3627 - protein, 18 aa, Artificial Sequence
  ErbB3 binding MRD
PRWTCEWYQARQSCSLGQ

SEQ ID NO: 3628 - protein, 20 aa, Artificial Sequence
  ErbB3 binding MRD
KFHMCQVYPSRNWHVWVETL

SEQ ID NO: 3629 - protein, 19 aa, Artificial Sequence
  ErbB3 binding MRD
VEHLCSEIPFWNVQCLARF

SEQ ID NO: 3630 - protein, 20 aa, Artificial Sequence
  ErbB3 binding MRD
KLFLCQVYPSERWHVCVESL

SEQ ID NO: 3631 - protein, 20 aa, Artificial Sequence
  ErbB3 binding MRD
HLIMCQVYPSGKWHVCLATT

SEQ ID NO: 3632 - protein, 19 aa, Artificial Sequence
  ErbB3 binding MRD
AVELCFHHTQEWTYCLWRF

SEQ ID NO: 3633 - protein, 20 aa, Artificial Sequence
  ErbB3 binding MRD
GEQLCSKIPSSDALWWVRLL

SEQ ID NO: 3634 - protein, 17 aa, Artificial Sequence
  ErbB3 binding MRD
DALRCFEWVKRNCLLSS

SEQ ID NO: 3635 - protein, 20 aa, Artificial Sequence
  ErbB3 binding MRD
KFMMCQVYPSQKWHVCVETF

SEQ ID NO: 3636 - protein, 19 aa, Artificial Sequence
  ErbB3 binding MRD
VEHLCSKIPFWHVQCLARI

SEQ ID NO: 3637 - protein, 21 aa, Artificial Sequence
  ErbB3 binding MRD
RYFYMCQVYPSERWQVCVGTS

SEQ ID NO: 3638 - protein, 21 aa, Artificial Sequence
  ErbB3 binding MRD
SNLYLCQVYPSGKYHICIEAL

SEQ ID NO: 3639 - protein, 21 aa, Artificial Sequence
  ErbB3 binding MRD
YSEPYCPFLNPTWKNECIARS

SEQ ID NO: 3640 - protein, 21 aa, Artificial Sequence
  ErbB3 binding MRD
TSEPYCPFLNPIWKAECISRT

SEQ ID NO: 3641 - protein, 21 aa, Artificial Sequence
  ErbB3 binding MRD
SYEPYCPFLNPTWKEQCIIRS

SEQ ID NO: 3642 - protein, 21 aa, Artificial Sequence
  ErbB3 binding MRD
LNEPYCPFMNPNWKAECLARM

SEQ ID NO: 3643 - protein, 21 aa, Artificial Sequence
  ErbB3 binding MRD
SKGPYCPFLNPIWKDECIARI

SEQ ID NO: 3644 - protein, 21 aa, Artificial Sequence
  ErbB3 binding MRD
NSEPYCPFINPIWKAECIART

SEQ ID NO: 3645 - protein, 21 aa, Artificial Sequence
  ErbB3 binding MRD
QSKPYCPFLNPTWKAQCIARS

SEQ ID NO: 3646 - protein, 21 aa, Artificial Sequence
  ErbB3 binding MRD
TSTPYCPFLNPIWKAECLSRI

SEQ ID NO: 3647 - protein, 21 aa, Artificial Sequence
  ErbB3 binding MRD
ISEPYCPFMNPTWKEQCLART

SEQ ID NO: 3648 - protein, 21 aa, Artificial Sequence
  ErbB3 binding MRD
VNDPYCPFLNPTWKAECIART

SEQ ID NO: 3649 - protein, 21 aa, Artificial Sequence
  ErbB3 binding MRD
SIEPYCPFLNPTWKAECLVRS

SEQ ID NO: 3650 - protein, 21 aa, Artificial Sequence
  ErbB3 binding MRD
VSEPYCPFLNPVWKDQCLSRI

SEQ ID NO: 3651 - protein, 18 aa, Artificial Sequence
  ErbB3 binding MRD
LPPPCYWTTWGKECQMFD

SEQ ID NO: 3652 - protein, 21 aa, Artificial Sequence
  ErbB3 binding MRD
KTEPYCPFLNPTWKAECIART

SEQ ID NO: 3653 - protein, 21 aa, Artificial Sequence
  ErbB3 binding MRD
TSDPYCPFVNPIWYNECIART

SEQ ID NO: 3654 - protein, 21 aa, Artificial Sequence
  ErbB3 binding MRD
TGSPYCPFLNPTWKAHCIARL

SEQ ID NO: 3655 - protein, 21 aa, Artificial Sequence
  ErbB3 binding MRD
ASEPYCPFLNPTWKDQCMARL

SEQ ID NO: 3656 - protein, 21 aa, Artificial Sequence
  ErbB3 binding MRD
RSEPYCPFLNPTWKAQCIYRT

SEQ ID NO: 3657 - protein, 21 aa, Artificial Sequence
  ErbB3 binding MRD
SIDPYCPFLNPTWLKECIARS

SEQ ID NO: 3658 - protein, 21 aa, Artificial Sequence
  ErbB3 binding MRD
IGEPYCPFANPTWKQECIART

SEQ ID NO: 3659 - protein, 21 aa, Artificial Sequence
  ErbB3 binding MRD
WSEPYCPFLNPAWKDQCLART

SEQ ID NO: 3660 - protein, 21 aa, Artificial Sequence
  ErbB3 binding MRD
MREPYCPFLNPTWKDQCIAIR

SEQ ID NO: 3661 - protein, 21 aa, Artificial Sequence
  ErbB3 binding MRD
YREPYCPFLNPIWKEQCIARS

SEQ ID NO: 3662 - protein, 21 aa, Artificial Sequence
  ErbB3 binding MRD
ISAPYCPFLNPIWKDECIART

SEQ ID NO: 3663 - protein, 21 aa, Artificial Sequence
  ErbB3 binding MRD
LREPYCPFLNPIWNVECLARS

SEQ ID NO: 3664 - protein, 21 aa, Artificial Sequence
  ErbB3 binding MRD
SSEPYCPFHNPTWKDQCLARS

SEQ ID NO: 3665 - protein, 21 aa, Artificial Sequence
  ErbB3 binding MRD
DSEPYCPFLNPTWKDQCLARF

SEQ ID NO: 3666 - protein, 21 aa, Artificial Sequence
  ErbB3 binding MRD
NSEPYCPFLNPSWKASCIARM

SEQ ID NO: 3667 - protein, 21 aa, Artificial Sequence
  ErbB3 binding MRD
TSEPYCPFLNPIWKDQCIART

SEQ ID NO: 3668 - protein, 21 aa, Artificial Sequence
  ErbB3 binding MRD
RSEPYCPFLNPIWKNECIARS

SEQ ID NO: 3669 - protein, 21 aa, Artificial Sequence
  ErbB3 binding MRD
FSEPYCPFINPTWKAQCLARI

SEQ ID NO: 3670 - protein, 21 aa, Artificial Sequence
  ErbB3 binding MRD
LNEPYCPFLNPIWKDECLART

SEQ ID NO: 3671 - protein, 21 aa, Artificial Sequence
  ErbB3 binding MRD
SREIYCPFLNPIWLAECIARA

SEQ ID NO: 3672 - protein, 21 aa, Artificial Sequence
  ErbB3 binding MRD
LTEPYCPFLNPTWKDQCLARR

SEQ ID NO: 3673 - protein, 21 aa, Artificial Sequence
  ErbB3 binding MRD
SKDPYCPFVNPIWKHECIVRS

SEQ ID NO: 3674 - protein, 21 aa, Artificial Sequence
  ErbB3 binding MRD
HSEPYCPFLNPIWKEQCMVRS

SEQ ID NO: 3675 - protein, 21 aa, Artificial Sequence
  ErbB3 binding MRD
SSEPYCPFLNPTWKHECLLRT

SEQ ID NO: 3676 - protein, 21 aa, Artificial Sequence
  ErbB3 binding MRD
ESEPYCPFTNPTWKAQCIARS

SEQ ID NO: 3677 - protein, 21 aa, Artificial Sequence
  ErbB3 binding MRD
YNEPYCPFINPIWKAECIART

SEQ ID NO: 3678 - protein, 21 aa, Artificial Sequence
  ErbB3 binding MRD
ISEPYCPFQNPTWKFQCLIRS

SEQ ID NO: 3679 - protein, 21 aa, Artificial Sequence
  ErbB3 binding MRD
RSEPYCPFLNPTWKEQCIARQ

SEQ ID NO: 3680 - protein, 21 aa, Artificial Sequence
  ErbB3 binding MRD
GRETYCPFLNPIWKAQCLART

SEQ ID NO: 3681 - protein, 21 aa, Artificial Sequence
  ErbB3 binding MRD
KSEPYCPFLNPIWKDQCIVRS

SEQ ID NO: 3682 - protein, 21 aa, Artificial Sequence
  ErbB3 binding MRD
VIEPYCPFLNPTWKDHCIART

SEQ ID NO: 3683 - protein, 21 aa, Artificial Sequence
  ErbB3 binding MRD
MSDPYCPFQNPIWKAACIART

SEQ ID NO: 3684 - protein, 21 aa, Artificial Sequence
  ErbB3 binding MRD
ESEPYCPFVNPIWKAECIARH

SEQ ID NO: 3685 - protein, 21 aa, Artificial Sequence
  ErbB3 binding MRD
YNEPYCPFVNPTWKAACVART

SEQ ID NO: 3686 - protein, 21 aa, Artificial Sequence
  ErbB3 binding MRD
YSKPYCPFINPIWKEQCIARH

SEQ ID NO: 3687 - protein, 21 aa, Artificial Sequence
  ErbB3 binding MRD
LIEPYCPFLNPTWYDQCIARS

SEQ ID NO: 3688 - protein, 21 aa, Artificial Sequence
  ErbB3 binding MRD
REVPYCPFLNPIWKEQCIIRT

SEQ ID NO: 3689 - protein, 21 aa, Artificial Sequence
  ErbB3 binding MRD
SLQAYCPFVNPTWKNECLARI

SEQ ID NO: 3690 - protein, 21 aa, Artificial Sequence
  ErbB3 binding MRD
LSEAYCPFLNPTWKQHCIALT

SEQ ID NO: 3691 - protein, 21 aa, Artificial Sequence
  ErbB3 binding MRD
MSEPYCPFLNPTWKEQCLARS

SEQ ID NO: 3692 - protein, 21 aa, Artificial Sequence
  ErbB3 binding MRD
LNEPYCPFLNPIWKNQCIARL

SEQ ID NO: 3693 - protein, 21 aa, Artificial Sequence
  ErbB3 binding MRD
PSKPYCPFLNPYWKAECMSRS

SEQ ID NO: 3694 - protein, 21 aa, Artificial Sequence
  ErbB3 binding MRD
ISEPYCPFLNPTWKDACIARS

SEQ ID NO: 3695 - protein, 19 aa, Artificial Sequence
  ErbB3 binding MRD
PDSWCHTLYWDLLYCVNQE

SEQ ID NO: 3696 - protein, 21 aa, Artificial Sequence
  ErbB3 binding MRD
QGQPYCPFVNPIWYAECMTRT

SEQ ID NO: 3697 - protein, 21 aa, Artificial Sequence
  ErbB3 binding MRD
RPEPYCPFKNPNWKEQCLARY

SEQ ID NO: 3698 - protein, 21 aa, Artificial Sequence
  ErbB3 binding MRD
SSEPYCPFINPTWKQECIART

SEQ ID NO: 3699 - protein, 21 aa, Artificial Sequence
  ErbB3 binding MRD
TTEPYCPFLNPIWKDQCIARW

SEQ ID NO: 3700 - protein, 21 aa, Artificial Sequence
  ErbB3 binding MRD
VSEPYCPFLNPYWKDQCIARH

SEQ ID NO: 3701 - protein, 21 aa, Artificial Sequence
  ErbB3 binding MRD
YNEPYCPFLNPTWKDQCLARI

SEQ ID NO: 3702 - protein, 21 aa, Artificial Sequence
  ErbB3 binding MRD
RSEPYCPFYNPIWYDHCVALT

SEQ ID NO: 3703 - protein, 21 aa, Artificial Sequence
  ErbB3 binding MRD
NPEPYCPFLNPIWKEQCILRS

SEQ ID NO: 3704 - protein, 21 aa, Artificial Sequence
  ErbB3 binding MRD
LSGLYCPFLNPTWKDQCIARM

SEQ ID NO: 3705 - protein, 21 aa, Artificial Sequence
  ErbB3 binding MRD
ISQPYCPFTNPTWLAECIARS

SEQ ID NO: 3706 - protein, 21 aa, Artificial Sequence
  ErbB3 binding MRD
LNTPYCPFINPTWKDECLARS

SEQ ID NO: 3707 - protein, 18 aa, Artificial Sequence
  ErbB3 binding MRD
YEEHCRLFPADWICSLLQ

SEQ ID NO: 3708 - protein, 21 aa, Artificial Sequence
  ErbB3 binding MRD
NSEPYCPFLNPSWKAQCIARS

SEQ ID NO: 3709 - protein, 19 aa, Artificial Sequence
  ErbB3 binding MRD
ADSWCHTLYWNLRHCEIQE

SEQ ID NO: 3710 - protein, 21 aa, Artificial Sequence
  ErbB3 binding MRD
SSEPYCPFLNPTWKEQCIART

SEQ ID NO: 3711 - protein, 21 aa, Artificial Sequence
  ErbB3 binding MRD
DTKPYCPFLNPIWKNQCIERT

SEQ ID NO: 3712 - protein, 21 aa, Artificial Sequence
  ErbB3 binding MRD
TRDPYCPFLNPIWKDECFART

SEQ ID NO: 3713 - protein, 21 aa, Artificial Sequence
  ErbB3 binding MRD
KEEAYCPFLNPLWKDECVART

SEQ ID NO: 3714 - protein, 19 aa, Artificial Sequence
  ErbB3 binding MRD
PESWCHTLYWNLQHCLSQE

SEQ ID NO: 3715 - protein, 21 aa, Artificial Sequence
  ErbB3 binding MRD
MSEPYCPFQNPTWKHECIART

SEQ ID NO: 3716 - protein, 21 aa, Artificial Sequence
  ErbB3 binding MRD
DSDPYCPFVNPIWKAQCIARS

SEQ ID NO: 3717 - protein, 21 aa, Artificial Sequence
  ErbB3 binding MRD
YSEPYCPFVNPTWLDQCIART

SEQ ID NO: 3718 - protein, 21 aa, Artificial Sequence
  ErbB3 binding MRD
YSEPYCPFLNPTWKAQCMAMI

SEQ ID NO: 3719 - protein, 21 aa, Artificial Sequence
  ErbB3 binding MRD
LSEPYCPFLNPTWKAACLARI

SEQ ID NO: 3720 - protein, 21 aa, Artificial Sequence
  ErbB3 binding MRD
IRKPYCPFLNPTWYNECIQRS

SEQ ID NO: 3721 - protein, 21 aa, Artificial Sequence
  ErbB3 binding MRD
QGEPYCPFLNPAWKDACIERL

SEQ ID NO: 3722 - protein, 21 aa, Artificial Sequence
  ErbB3 binding MRD
GSEPYCPFFNPIWKDQCITRF

SEQ ID NO: 3723 - protein, 21 aa, Artificial Sequence
  ErbB3 binding MRD
RSEPYCPFLNPTWKEHCIART

SEQ ID NO: 3724 - protein, 21 aa, Artificial Sequence
  ErbB3 binding MRD
TNEPYCPFLNPTWKQQCIART

SEQ ID NO: 3725 - protein, 21 aa, Artificial Sequence
  ErbB3 binding MRD
TSEPYCPFENPIWKAQCISRS

SEQ ID NO: 3726 - protein, 21 aa, Artificial Sequence
  ErbB3 binding MRD
KSEPYCPFLNPYWKDQCIARS

SEQ ID NO: 3727 - protein, 21 aa, Artificial Sequence
  ErbB3 binding MRD
LREPYCPFLNPTWKAECIARI

SEQ ID NO: 3728 - protein, 21 aa, Artificial Sequence
  ErbB3 binding MRD
TNDPYCPFLNPIWKAQCLDRY

SEQ ID NO: 3729 - protein, 21 aa, Artificial Sequence
  ErbB3 binding MRD
KGQPYCPFLNPIWKEQCLART

SEQ ID NO: 3730 - protein, 21 aa, Artificial Sequence
  ErbB3 binding MRD
SSEAYCPFLNPTWKQECIARL

SEQ ID NO: 3731 - protein, 19 aa, Artificial Sequence
  ErbB3 binding MRD
ANSWCHTLYWDLMYCVWQE

SEQ ID NO: 3732 - protein, 21 aa, Artificial Sequence
  ErbB3 binding MRD
TIEPYCPFLNPIWKDQCIARS

SEQ ID NO: 3733 - protein, 21 aa, Artificial Sequence
  ErbB3 binding MRD
QHEPYCPFLNPVWKHECIART

SEQ ID NO: 3734 - protein, 21 aa, Artificial Sequence
  ErbB3 binding MRD
IREPYCPFLNPTWKAQCIART

SEQ ID NO: 3735 - protein, 21 aa, Artificial Sequence
  ErbB3 binding MRD
HSAPYCPFLNPIWKDECIARS

SEQ ID NO: 3736 - protein, 21 aa, Artificial Sequence
  ErbB3 binding MRD
VSEPYCPFLNPTWKAHCIELS

SEQ ID NO: 3737 - protein, 21 aa, Artificial Sequence
  ErbB3 binding MRD
SSDPYCPFLNPTWYDQCIERY

SEQ ID NO: 3738 - protein, 21 aa, Artificial Sequence
  ErbB3 binding MRD
ISDPYCPFVNPYWKAECIART

SEQ ID NO: 3739 - protein, 21 aa, Artificial Sequence
  ErbB3 binding MRD
NIDPYCPFLNPTWKAECIARI

SEQ ID NO: 3740 - protein, 21 aa, Artificial Sequence
  ErbB3 binding MRD
PREPYCPFLNPLWKNQCIERT

SEQ ID NO: 3741 - protein, 21 aa, Artificial Sequence
  ErbB3 binding MRD
IRVPYCPFQNPTWYDQCIART

SEQ ID NO: 3742 - protein, 19 aa, Artificial Sequence
  ErbB3 binding MRD
PDSWCHTLYWHLQHCLSQE

SEQ ID NO: 3743 - protein, 21 aa, Artificial Sequence
  ErbB3 binding MRD
TNDPYCPFLNPTWKAECIARH

SEQ ID NO: 3744 - protein, 21 aa, Artificial Sequence
  ErbB3 binding MRD
VSEPYCPFLNPTWKAQCLNRI

SEQ ID NO: 3745 - protein, 21 aa, Artificial Sequence
  ErbB3 binding MRD
PIDPYCPFLNPIWKEQCHARS

SEQ ID NO: 3746 - protein, 21 aa, Artificial Sequence
  ErbB3 binding MRD
VREPYCPFLNPTWKNECIART

SEQ ID NO: 3747 - protein, 21 aa, Artificial Sequence
  ErbB3 binding MRD
LIEPYCPFLNPIWKDQCLART

SEQ ID NO: 3748 - protein, 21 aa, Artificial Sequence
  ErbB3 binding MRD
PKFFMCQVYPSGKWHVCTGTV

SEQ ID NO: 3749 - protein, 21 aa, Artificial Sequence
  ErbB3 binding MRD
PKYYMCQIYPSLKWNVCLETL

SEQ ID NO: 3750 - protein, 21 aa, Artificial Sequence
  ErbB3 binding MRD
LNFYICKLYPSANLHVCVDTL

SEQ ID NO: 3751 - protein, 21 aa, Artificial Sequence
  ErbB3 binding MRD
RSEPYCPFLNPVWKDQCIARS

SEQ ID NO: 3752 - protein, 21 aa, Artificial Sequence
  ErbB3 binding MRD
SSEPYCPFLNPIWKYHCIARS

SEQ ID NO: 3753 - protein, 21 aa, Artificial Sequence
  ErbB3 binding MRD
PGSPYCPFLNPFWKEQCIVRT

SEQ ID NO: 3754 - protein, 17 aa, Artificial Sequence
  ErbB3 binding MRD
YEEHCALFPTDWICTLH

SEQ ID NO: 3755 - protein, 21 aa, Artificial Sequence
  ErbB3 binding MRD
FIEPYCPFINPTWKAECLART

SEQ ID NO: 3756 - protein, 21 aa, Artificial Sequence
  ErbB3 binding MRD
DKFYLCQIYPSERWHVCVWSS

SEQ ID NO: 3757 - protein, 21 aa, Artificial Sequence
  ErbB3 binding MRD
EKFKMCQIYPSKNWAVCVETF

SEQ ID NO: 3758 - protein, 21 aa, Artificial Sequence
  ErbB3 binding MRD
HKFYMCQVYPSEKWHVCVETL

SEQ ID NO: 3759 - protein, 21 aa, Artificial Sequence
  ErbB3 binding MRD
LSEPYCPFLNPSWKAECIARS

SEQ ID NO: 3760 - protein, 21 aa, Artificial Sequence
  ErbB3 binding MRD
LSEPYCPFLNPIWKEQCIARS

SEQ ID NO: 3761 - protein, 21 aa, Artificial Sequence
  ErbB3 binding MRD
LSEPYCPFLNPTWKDQCIARS

SEQ ID NO: 3762 - protein, 21 aa, Artificial Sequence
  ErbB3 binding MRD
RSEPYCPFVNPIWKAECIVRS

SEQ ID NO: 3763 - protein, 21 aa, Artificial Sequence
  ErbB3 binding MRD
QFEPYCPFLNPTWKEQCIARI

SEQ ID NO: 3764 - protein, 21 aa, Artificial Sequence
  ErbB3 binding MRD
PIEPYCPFQNPTWKAQCIART

SEQ ID NO: 3765 - protein, 21 aa, Artificial Sequence
  ErbB3 binding MRD
YRQPYCPFLNPTWKAQCMART

SEQ ID NO: 3766 - protein, 21 aa, Artificial Sequence
  ErbB3 binding MRD
DNFYMCQVYPSLKWHICVSIL

SEQ ID NO: 3767 - protein, 21 aa, Artificial Sequence
  ErbB3 binding MRD
SMFFMCQVYPSEKWHVCVYPL

SEQ ID NO: 3768 - protein, 21 aa, Artificial Sequence
  ErbB3 binding MRD
SKFFMCQVYPSERWHVCIEPL

SEQ ID NO: 3769 - protein, 21 aa, Artificial Sequence
  ErbB3 binding MRD
LKFYMCQVYPSGNWNVCTATQ

SEQ ID NO: 3770 - protein, 21 aa, Artificial Sequence
  ErbB3 binding MRD
NSEPYCPFHNPTWKAACMART

SEQ ID NO: 3771 - protein, 21 aa, Artificial Sequence
  ErbB3 binding MRD
RSEPYCPFLNPIWKEQCIART

SEQ ID NO: 3772 - protein, 21 aa, Artificial Sequence
  ErbB3 binding MRD
SREPYCPFLNPTWKEQCIARI

SEQ ID NO: 3773 - protein, 21 aa, Artificial Sequence
  ErbB3 binding MRD
MREPYCPFLNPSWKEQCIARS

SEQ ID NO: 3774 - protein, 21 aa, Artificial Sequence
  ErbB3 binding MRD
LREPYCPFLNPVWKNECIART

SEQ ID NO: 3775 - protein, 21 aa, Artificial Sequence
  ErbB3 binding MRD
ITDTYCPFQNPIWKAECIART

SEQ ID NO: 3776 - protein, 21 aa, Artificial Sequence
  ErbB3 binding MRD
FNFFMCQVYPSEKWHICVKSL

SEQ ID NO: 3777 - protein, 21 aa, Artificial Sequence
  ErbB3 binding MRD
KKFYMCQIYPSEKWHVCVERI

SEQ ID NO: 3778 - protein, 21 aa, Artificial Sequence
  ErbB3 binding MRD
TRYSMCQVYPSLRWHVCVENL

SEQ ID NO: 3779 - protein, 21 aa, Artificial Sequence
  ErbB3 binding MRD
LGEPYCPFLNPTWKAQCLYMS

SEQ ID NO: 3780 - protein, 21 aa, Artificial Sequence
  ErbB3 binding MRD
SSEPYCPFLNPIWKNECLARQ

SEQ ID NO: 3781 - protein, 21 aa, Artificial Sequence
  ErbB3 binding MRD
RSEPYCPFLNPIWKEHCINRS

SEQ ID NO: 3782 - protein, 21 aa, Artificial Sequence
  ErbB3 binding MRD
HSQPYCPFQNPTWYEQCIART

SEQ ID NO: 3783 - protein, 21 aa, Artificial Sequence
  ErbB3 binding MRD
SNEPYCPFLNPSWKDACLQRT

SEQ ID NO: 3784 - protein, 21 aa, Artificial Sequence
  ErbB3 binding MRD
LSDVYCPFVNPTWKAECIARS

SEQ ID NO: 3785 - protein, 21 aa, Artificial Sequence
  ErbB3 binding MRD
SDFFMCQVYPSQKWHVCVKSL

SEQ ID NO: 3786 - protein, 19 aa, Artificial Sequence
  ErbB3 binding MRD
PDSWCHTLYWSLLHCARQE

SEQ ID NO: 3787 - protein, 21 aa, Artificial Sequence
  ErbB3 binding MRD
LPFFMCQVYPSKSWHVCVETS

SEQ ID NO: 3788 - protein, 21 aa, Artificial Sequence
  ErbB3 binding MRD
LSEPYCPFQNPTWKEQCVARS

SEQ ID NO: 3789 - protein, 19 aa, Artificial Sequence
  ErbB3 binding MRD
ADSWCHTLFWNLKHCLIQE

SEQ ID NO: 3790 - protein, 21 aa, Artificial Sequence
  ErbB3 binding MRD
GGDPYCPFLNPTWKAECIART

SEQ ID NO: 3791 - protein, 21 aa, Artificial Sequence
  ErbB3 binding MRD
VREPYCPFLNPIWKDQCIART

SEQ ID NO: 3792 - protein, 21 aa, Artificial Sequence
  ErbB3 binding MRD
ASEPYCPFLNPIWKDQCIART

SEQ ID NO: 3793 - protein, 21 aa, Artificial Sequence
  ErbB3 binding MRD
SSEPYCPFQNPTWKDQCIARN

SEQ ID NO: 3794 - protein, 19 aa, Artificial Sequence
  ErbB3 binding MRD
ADSWCHTLYWNLLYCANQE

SEQ ID NO: 3795 - protein, 21 aa, Artificial Sequence
  ErbB3 binding MRD
SWFFMCQIYPSLKWHVCVETL

SEQ ID NO: 3796 - protein, 21 aa, Artificial Sequence
  ErbB3 binding MRD
STFYMCKVYPSQRWHVCVDTL

SEQ ID NO: 3797 - protein, 21 aa, Artificial Sequence
  ErbB3 binding MRD
SREPYCPFLNPTWYDECIART

SEQ ID NO: 3798 - protein, 21 aa, Artificial Sequence
  ErbB3 binding MRD
QSEPYCPFLNPMWKEQCIVRI

SEQ ID NO: 3799 - protein, 21 aa, Artificial Sequence
  ErbB3 binding MRD
TSEPYCPFDNPTWKARCLAML

SEQ ID NO: 3800 - protein, 21 aa, Artificial Sequence
  ErbB3 binding MRD
ARQPYCPFLNPTWKNECMARS

SEQ ID NO: 3801 - protein, 21 aa, Artificial Sequence
  ErbB3 binding MRD
PSEPYCPFLNPIWKAECIART

SEQ ID NO: 3802 - protein, 20 aa, Artificial Sequence
  ErbB3 binding MRD
IAILTALSLTLSGRTSASSE

SEQ ID NO: 3803 - protein, 21 aa, Artificial Sequence
  ErbB3 binding MRD
YSAPDCPFVNPIWKNACIARY

SEQ ID NO: 3804 - protein, 19 aa, Artificial Sequence
  ErbB3 binding MRD
ADSWCHTLFWQLQHCVWQE

SEQ ID NO: 3805 - protein, 21 aa, Artificial Sequence
  ErbB3 binding MRD
LNFSMCQVYPSYKWHVCVGTL

SEQ ID NO: 3806 - protein, 21 aa, Artificial Sequence
  ErbB3 binding MRD
MEFFMCQVYPSEKWHVCVAKL

SEQ ID NO: 3807 - protein, 21 aa, Artificial Sequence
  ErbB3 binding MRD
LRYYICQIYPSEKYHVCVDTL

SEQ ID NO: 3808 - protein, 21 aa, Artificial Sequence
  ErbB3 binding MRD
VIEPYCPFLNPTWKAECLARS

SEQ ID NO: 3809 - protein, 21 aa, Artificial Sequence
  ErbB3 binding MRD
STEPYCPFLNPIWKDACIARH

SEQ ID NO: 3810 - protein, 21 aa, Artificial Sequence
  ErbB3 binding MRD
WRDPYCPFLNPIWKEQCIARY

SEQ ID NO: 3811 - protein, 21 aa, Artificial Sequence
  ErbB3 binding MRD
RSEPYCPFLNPTWKDQCMART

SEQ ID NO: 3812 - protein, 21 aa, Artificial Sequence
  ErbB3 binding MRD
VIDPYCPFLNPIWKEQCQVRT

SEQ ID NO: 3813 - protein, 21 aa, Artificial Sequence
  ErbB3 binding MRD
SKFFMCQVYPSKKWHVCVEAL

SEQ ID NO: 3814 - protein, 21 aa, Artificial Sequence
  ErbB3 binding MRD
IKFFMCQVYPSELWHVCVQKQ

SEQ ID NO: 3815 - protein, 21 aa, Artificial Sequence
  ErbB3 binding MRD
TTFFMCQLYPSGNWHVCTETL

SEQ ID NO: 3816 - protein, 21 aa, Artificial Sequence
  ErbB3 binding MRD
FKFFMCQTYPSEKWHVCVEKL

SEQ ID NO: 3817 - protein, 21 aa, Artificial Sequence
  ErbB3 binding MRD
SSEPYCPFLNPLWHEQCLARI

SEQ ID NO: 3818 - protein, 21 aa, Artificial Sequence
  ErbB3 binding MRD
AREPYCPFLNPIWKAECVARY

SEQ ID NO: 3819 - protein, 21 aa, Artificial Sequence
  ErbB3 binding MRD
PSEPYCPFVNPTWLDECIARS

SEQ ID NO: 3820 - protein, 21 aa, Artificial Sequence
  ErbB3 binding MRD
ASEPYCPFLNPIWYEQCINRT

SEQ ID NO: 3821 - protein, 21 aa, Artificial Sequence
  ErbB3 binding MRD
PISPYCPFLNPIWYEECIARS

SEQ ID NO: 3822 - protein, 21 aa, Artificial Sequence
  ErbB3 binding MRD
VGEPYCPFMNPIWKEQCILRS

SEQ ID NO: 3823 - protein, 19 aa, Artificial Sequence
  ErbB3 binding MRD
ADSWCHTLYWQLLHCVNQE

SEQ ID NO: 3824 - protein, 19 aa, Artificial Sequence
  ErbB3 binding MRD
ADSWCHTLYWQLLHCVSQE

SEQ ID NO: 3825 - protein, 20 aa, Artificial Sequence
  ErbB3 binding MRD
DQVRCPFQNPVWWSHCMYLL

SEQ ID NO: 3826 - protein, 20 aa, Artificial Sequence
  ErbB3 binding MRD
DQVRCPFQNPVWWSHCMYLL

SEQ ID NO: 3827 - protein, 20 aa, Artificial Sequence
  ErbB3 binding MRD
DQVRCPFQNPVWWSHCMYLL

SEQ ID NO: 3828 - protein, 18 aa, Artificial Sequence
  ErbB3 binding MRD
YTKHCQRLPTYKICNLFM

SEQ ID NO: 3829 - protein, 20 aa, Artificial Sequence
  ErbB3 binding MRD
DQVRCPFQNPVWWSHCMYLL

SEQ ID NO: 3830 - protein, 19 aa, Artificial Sequence
  ErbB3 binding MRD
ADSWCHTLYWQLQHCLSQE

SEQ ID NO: 3831 - protein, 20 aa, Artificial Sequence
  ErbB3 binding MRD
DQVRCPFQNPVWWSHCMYLL

SEQ ID NO: 3832 - protein, 20 aa, Artificial Sequence
  ErbB3 binding MRD
DQVRCPFQNPVWWSHCMYLL

SEQ ID NO: 3833 - protein, 20 aa, Artificial Sequence
  ErbB3 binding MRD
DQVRCPFQNPVWWSHCMYLL

SEQ ID NO: 3834 - protein, 19 aa, Artificial Sequence
  ErbB3 binding MRD
TDSWCHTLYWQLHHCAILE

SEQ ID NO: 3835 - protein, 20 aa, Artificial Sequence
  ErbB3 binding MRD
DQVRCPFQNPVWWSHCMYLL

SEQ ID NO: 3836 - protein, 20 aa, Artificial Sequence
  ErbB3 binding MRD
YQVTCPFLNPPWWSHCMYLL

SEQ ID NO: 3837 - protein, 20 aa, Artificial Sequence
  ErbB3 binding MRD
DQVRCPFQNPVWWSHCMYLL

SEQ ID NO: 3838 - protein, 19 aa, Artificial Sequence
  ErbB3 binding MRD
HRAPCFSCTACRQPCFSLT

SEQ ID NO: 3839 - protein, 20 aa, Artificial Sequence
  ErbB3 binding MRD
YQVTCPFFNPLWWSHCMYLL

SEQ ID NO: 3840 - protein, 20 aa, Artificial Sequence
  ErbB3 binding MRD
SEPYCPFLNPTWKSQCIART

SEQ ID NO: 3841 - protein, 20 aa, Artificial Sequence
  ErbB3 binding MRD
YEVQCPFQNPIWWKHCMDLI

SEQ ID NO: 3842 - protein, 20 aa, Artificial Sequence
  ErbB3 binding MRD
ESCWTWDHWYQYWVPQRCDP

SEQ ID NO: 3843 - protein, 19 aa, Artificial Sequence
  ErbB3 binding MRD
ANSWCHTLYWQLHHCEILE

SEQ ID NO: 3844 - protein, 18 aa, Artificial Sequence
  ErbB3 binding MRD
QACNFTSLGWYQEFYCLR

SEQ ID NO: 3845 - protein, 20 aa, Artificial Sequence
  ErbB3 binding MRD
WACRWEWHAAWQKWDEFCVE

SEQ ID NO: 3846 - protein, 17 aa, Artificial Sequence
  ErbB3 binding MRD
AYCYRSIISRNSTCSAL

SEQ ID NO: 3847 - protein, 20 aa, Artificial Sequence
  ErbB3 binding MRD
VYCFLNFKTMNYAGEFWCRH

SEQ ID NO: 3848 - protein, 20 aa, Artificial Sequence
  ErbB3 binding MRD
SWCMWYYESTYSAPYYYCSV

SEQ ID NO: 3849 - protein, 20 aa, Artificial Sequence
  ErbB3 binding MRD
SQCHWWHEPYGMFQTEICLW

SEQ ID NO: 3850 - protein, 19 aa, Artificial Sequence
  ErbB3 binding MRD
GLHGCQYVQMFFHFCAPKT

SEQ ID NO: 3851 - protein, 18 aa, Artificial Sequence
  ErbB3 binding MRD
WQHVCWQDWYSWVCTSGY

SEQ ID NO: 3852 - protein, 19 aa, Artificial Sequence
  ErbB3 binding MRD
PWRGCWWDPWQPWDCVPFF

SEQ ID NO: 3853 - protein, 17 aa, Artificial Sequence
  ErbB3 binding MRD
QERLCRQIWQHYCVRYM

SEQ ID NO: 3854 - protein, 17 aa, Artificial Sequence
  ErbB3 binding MRD
QPRECNYVPAWYCHYYS

SEQ ID NO: 3855 - protein, 16 aa, Artificial Sequence
  ErbB3 binding MRD
VYQYHCDWYTCLFRHT

SEQ ID NO: 3856 - protein, 18 aa, Artificial Sequence
  ErbB3 binding MRD
FQGHCALFPTDWICTLKS

SEQ ID NO: 3857 - protein, 18 aa, Artificial Sequence
  ErbB3 binding MRD
QMCHMEWHNHVYWQVCHW

SEQ ID NO: 3858 - protein, 15 aa, Artificial Sequence
  ErbB3 binding MRD
WMRQCHLETECQRAS

SEQ ID NO: 3859 - protein, 18 aa, Artificial Sequence
  ErbB3 binding MRD
SAVACFHPPYFFICVASG

SEQ ID NO: 3860 - protein, 16 aa, Artificial Sequence
  ErbB3 binding MRD
LRRRCHSRFMQCSNPG

SEQ ID NO: 3861 - protein, 15 aa, Artificial Sequence
  ErbB3 binding MRD
GQTWCHWGMYCISTT

SEQ ID NO: 3862 - protein, 19 aa, Artificial Sequence
  ErbB3 binding MRD
WEYQCEWGYSYKPQCWLSA

SEQ ID NO: 3863 - protein, 20 aa, Artificial Sequence
  ErbB3 binding MRD
LPLTCWVLEWHEWLACVSYD

SEQ ID NO: 3864 - protein, 19 aa, Artificial Sequence
  ErbB3 binding MRD
WSYSCVFLPWMYHMCYLET

SEQ ID NO: 3865 - protein, 18 aa, Artificial Sequence
  ErbB3 binding MRD
WFYQCWQSPWHTECSWVN

SEQ ID NO: 3866 - protein, 17 aa, Artificial Sequence
  ErbB3 binding MRD
RDQPCWYKIMTGCLCMP

SEQ ID NO: 3867 - protein, 16 aa, Artificial Sequence
  ErbB3 binding MRD
LPPSWCVRGECSWLLL

SEQ ID NO: 3868 - protein, 19 aa, Artificial Sequence
  ErbB3 binding MRD
DESDCKQLPICHGHCLVPL

SEQ ID NO: 3869 - protein, 18 aa, Artificial Sequence
  ErbB3 binding MRD
YQVFCEWSYWEYHCISNQ

SEQ ID NO: 3870 - protein, 19 aa, Artificial Sequence
  ErbB3 binding MRD
VQHHCLYRQHSYRECVRHY

SEQ ID NO: 3871 - protein, 17 aa, Artificial Sequence
  ErbB3 binding MRD
YIDCVPVLPGFYLPQLG

SEQ ID NO: 3872 - protein, 18 aa, Artificial Sequence
  ErbB3 binding MRD
WHQACEYQYYNWECSMGW

SEQ ID NO: 3873 - protein, 18 aa, Artificial Sequence
  ErbB3 binding MRD
ETFSCYVFPFFYECYSTP

SEQ ID NO: 3874 - protein, 16 aa, Artificial Sequence
  ErbB3 binding MRD
WTNLFCWGPLCKCLQQ

SEQ ID NO: 3875 - protein, 18 aa, Artificial Sequence
  ErbB3 binding MRD
YQVMCLHQPFVSFCHYET

SEQ ID NO: 3876 - protein, 18 aa, Artificial Sequence
  ErbB3 binding MRD
GTHWCRYYPSYAECYVWL

SEQ ID NO: 3877 - protein, 16 aa, Artificial Sequence
  ErbB3 binding MRD
TWLCDCSYWGCWWELG

SEQ ID NO: 3878 - protein, 18 aa, Artificial Sequence
  ErbB3 binding MRD
LWVGCYIPPWTEWCPIAW

SEQ ID NO: 3879 - protein, 15 aa, Artificial Sequence
  ErbB3 binding MRD
VWLMCWHYIFCPSKL

SEQ ID NO: 3880 - protein, 18 aa, Artificial Sequence
  ErbB3 binding MRD
PEYLCWVYPYAPQCWDLV

SEQ ID NO: 3881 - protein, 18 aa, Artificial Sequence
  ErbB3 binding MRD
VEHLCSKIPFWMFSAWPG

SEQ ID NO: 3882 - protein, 17 aa, Artificial Sequence
  ErbB3 binding MRD
ICEACPKHVSEQCIRLR

SEQ ID NO: 3883 - protein, 18 aa, Artificial Sequence
  ErbB3 binding MRD
WRVICMARPTGEQCEWVW

SEQ ID NO: 3884 - protein, 19 aa, Artificial Sequence
  ErbB3 binding MRD
DWSKCIQFSLPHDHCLMFM

SEQ ID NO: 3885 - protein, 20 aa, Artificial Sequence
  ErbB3 binding MRD
SRWECAWIVGYHHWDCRWLF

SEQ ID NO: 3886 - protein, 15 aa, Artificial Sequence
  ErbB3 binding MRD
SMEYCFWYHYCQLGV

SEQ ID NO: 3887 - protein, 18 aa, Artificial Sequence
  ErbB3 binding MRD
IFVMCEDSWPVPFCFSNR

SEQ ID NO: 3888 - protein, 18 aa, Artificial Sequence
  ErbB3 binding MRD
VEWMCYAYPFDPECYYNW

SEQ ID NO: 3889 - protein, 18 aa, Artificial Sequence
  ErbB3 binding MRD
DEHLCSISRSGMSFAWAG

SEQ ID NO: 3890 - protein, 21 aa, Artificial Sequence
  ErbB3 binding MRD
ASEPYCPFLNPVWKEQCIARL

SEQ ID NO: 3891 - protein, 21 aa, Artificial Sequence
  ErbB3 binding MRD
PREPYCPFHNPIWKNQCIART

SEQ ID NO: 3892 - protein, 21 aa, Artificial Sequence
  ErbB3 binding MRD
ESEPYCPFLNPIWKAHCIART

SEQ ID NO: 3893 - protein, 21 aa, Artificial Sequence
  ErbB3 binding MRD
DSEPYCPFLNPIWKEQCLARM

SEQ ID NO: 3894 - protein, 21 aa, Artificial Sequence
  ErbB3 binding MRD
TSDPYCPFLNPTWKAECIART

SEQ ID NO: 3895 - protein, 21 aa, Artificial Sequence
  ErbB3 binding MRD
WSEPYCPFTNPTWKAACIARS

SEQ ID NO: 3896 - protein, 21 aa, Artificial Sequence
  ErbB3 binding MRD
ARDPYCPFQNPIWYNECIART

SEQ ID NO: 3897 - protein, 21 aa, Artificial Sequence
  ErbB3 binding MRD
PREPYCPFHNPAWKAACVARA

SEQ ID NO: 3898 - protein, 21 aa, Artificial Sequence
  ErbB3 binding MRD
TNESYCPFLNPTWKAECMARI

SEQ ID NO: 3899 - protein, 21 aa, Artificial Sequence
  ErbB3 binding MRD
DREPYCPFLNPYWKDQCLART

SEQ ID NO: 3900 - protein, 21 aa, Artificial Sequence
  ErbB3 binding MRD
ISDPYCPFVNPIWKEQCIARN

SEQ ID NO: 3901 - protein, 21 aa, Artificial Sequence
  ErbB3 binding MRD
RNEPYCPFVNPIWKEQCIIRT

SEQ ID NO: 3902 - protein, 21 aa, Artificial Sequence
  ErbB3 binding MRD
LTTPYCPFENPTWKAQCIART

SEQ ID NO: 3903 - protein, 21 aa, Artificial Sequence
  ErbB3 binding MRD
SIEPYCPFLNPTWLEQCIARS

SEQ ID NO: 3904 - protein, 21 aa, Artificial Sequence
  ErbB3 binding MRD
KSEPYCPFLNPTWHDQCIARN

SEQ ID NO: 3905 - protein, 21 aa, Artificial Sequence
  ErbB3 binding MRD
IIGPYCPFLNPEWKDQCMART

SEQ ID NO: 3906 - protein, 21 aa, Artificial Sequence
  ErbB3 binding MRD
YREPYCPFQNPYWKDQCIARY

SEQ ID NO: 3907 - protein, 21 aa, Artificial Sequence
  ErbB3 binding MRD
AIEPYCPFLNPIWKDQCLARI

SEQ ID NO: 3908 - protein, 21 aa, Artificial Sequence
  ErbB3 binding MRD
MSRPYCPFLNPIWKEQCIART

SEQ ID NO: 3909 - protein, 21 aa, Artificial Sequence
  ErbB3 binding MRD
YNKPYCPFQNPTWKEACLARS

SEQ ID NO: 3910 - protein, 21 aa, Artificial Sequence
  ErbB3 binding MRD
SSEPYCPFLNPTWKAECIARS

SEQ ID NO: 3911 - protein, 21 aa, Artificial Sequence
  ErbB3 binding MRD
LSEPYCPFQNPIWKDKCIAMS

SEQ ID NO: 3912 - protein, 21 aa, Artificial Sequence
  ErbB3 binding MRD
SYEPYCPFLNPTWKAECIARI

SEQ ID NO: 3913 - protein, 21 aa, Artificial Sequence
  ErbB3 binding MRD
GSEPYCPFLNPTWKEQCIIRT

SEQ ID NO: 3914 - protein, 21 aa, Artificial Sequence
  ErbB3 binding MRD
SSEPYCPFLNPTWKSQCIARS

SEQ ID NO: 3915 - protein, 21 aa, Artificial Sequence
  ErbB3 binding MRD
RSEPYCPFLNPIWKDHCIART

SEQ ID NO: 3916 - protein, 21 aa, Artificial Sequence
  ErbB3 binding MRD
RSEPYCPFLNPTWKAECIARS

SEQ ID NO: 3917 - protein, 21 aa, Artificial Sequence
  ErbB3 binding MRD
SREPYCPFLNPIWKDKCISRT

SEQ ID NO: 3918 - protein, 21 aa, Artificial Sequence
  ErbB3 binding MRD
TSDPYCPFLNPIWKEQCIVRT

SEQ ID NO: 3919 - protein, 21 aa, Artificial Sequence
  ErbB3 binding MRD
EREPYCPFLNPTWKEQCLARH

SEQ ID NO: 3920 - protein, 21 aa, Artificial Sequence
  ErbB3 binding MRD
LREPYCPFLNPTWKAECIARS

SEQ ID NO: 3921 - protein, 21 aa, Artificial Sequence
  ErbB3 binding MRD
GSEPYCPFLNPTWKEQCLARL

SEQ ID NO: 3922 - protein, 21 aa, Artificial Sequence
  ErbB3 binding MRD
MSEPYCPFLNPIWKEQCIARS

SEQ ID NO: 3923 - protein, 21 aa, Artificial Sequence
  ErbB3 binding MRD
RGEPYCPFTNPIWKEQCINRS

SEQ ID NO: 3924 - protein, 21 aa, Artificial Sequence
  ErbB3 binding MRD
DADPYCPFLNPTWKAECLARS

SEQ ID NO: 3925 - protein, 21 aa, Artificial Sequence
  ErbB3 binding MRD
RGEPYCPFLNPAWKNECLART

SEQ ID NO: 3926 - protein, 21 aa, Artificial Sequence
  ErbB3 binding MRD
IIEPYCPFVNPNWKAQCIARS

SEQ ID NO: 3927 - protein, 21 aa, Artificial Sequence
  ErbB3 binding MRD
EDEPYCPFLNPIWKAQCLART

SEQ ID NO: 3928 - protein, 21 aa, Artificial Sequence
  ErbB3 binding MRD
FTEPYCPFINPTWKAECIARS

SEQ ID NO: 3929 - protein, 21 aa, Artificial Sequence
  ErbB3 binding MRD
TSEPYCPFLNPIWKEQCITRT

SEQ ID NO: 3930 - protein, 20 aa, Artificial Sequence
  ErbB3 binding MRD
VEPYCPFLNPTWKDACLART

SEQ ID NO: 3931 - protein, 21 aa, Artificial Sequence
  ErbB3 binding MRD
TSEPYCPFGNPIWKKECIART

SEQ ID NO: 3932 - protein, 21 aa, Artificial Sequence
  ErbB3 binding MRD
TSEPYCPFLNPTWKDECIARM

SEQ ID NO: 3933 - protein, 21 aa, Artificial Sequence
  ErbB3 binding MRD
SNEPYCPFLNPTWKAQCLARM

SEQ ID NO: 3934 - protein, 21 aa, Artificial Sequence
  ErbB3 binding MRD
YREPYCPFLNPTWKEQCIARS

SEQ ID NO: 3935 - protein, 21 aa, Artificial Sequence
  ErbB3 binding MRD
LNAPYCPFLNPNWYDQCIHRS

SEQ ID NO: 3936 - protein, 21 aa, Artificial Sequence
  ErbB3 binding MRD
SSDPYCPFLNPTWKQQCIERS

SEQ ID NO: 3937 - protein, 21 aa, Artificial Sequence
  ErbB3 binding MRD
ASEPYCPFLNPTWKEQCIART

SEQ ID NO: 3938 - protein, 21 aa, Artificial Sequence
  ErbB3 binding MRD
LSEPYCPFQNPTWYDECISRS

SEQ ID NO: 3939 - protein, 21 aa, Artificial Sequence
  ErbB3 binding MRD
SSEPYCPFLNPKWKHECIARS

SEQ ID NO: 3940 - protein, 21 aa, Artificial Sequence
  ErbB3 binding MRD
GSEPYCPFLNPIWKAECIARS

SEQ ID NO: 3941 - protein, 21 aa, Artificial Sequence
  ErbB3 binding MRD
RIEPYCPFVNPTWKDQCLART

SEQ ID NO: 3942 - protein, 21 aa, Artificial Sequence
  ErbB3 binding MRD
SIEPYCPFLNPTWKEQCIARS

SEQ ID NO: 3943 - protein, 21 aa, Artificial Sequence
  ErbB3 binding MRD
RTEPYCPFLNPTWKEQCIARS

SEQ ID NO: 3944 - protein, 21 aa, Artificial Sequence
  ErbB3 binding MRD
PSEPYCPFLNPTWKDQCLQRS

SEQ ID NO: 3945 - protein, 21 aa, Artificial Sequence
  ErbB3 binding MRD
YSEPYCPFLNPTWKAECIART

SEQ ID NO: 3946 - protein, 21 aa, Artificial Sequence
  ErbB3 binding MRD
TSEPYCPFLNPTWKEHCMART

SEQ ID NO: 3947 - protein, 21 aa, Artificial Sequence
  ErbB3 binding MRD
GSNPYCPFLNPIWKEACLART

SEQ ID NO: 3948 - protein, 21 aa, Artificial Sequence
  ErbB3 binding MRD
INEPYCPFQNPFWYAECLART

SEQ ID NO: 3949 - protein, 21 aa, Artificial Sequence
  ErbB3 binding MRD
TREPYCPFLNPTWLDQCIART

SEQ ID NO: 3950 - protein, 21 aa, Artificial Sequence
  ErbB3 binding MRD
IREPYCPFLNPSWKAECIARS

SEQ ID NO: 3951 - protein, 21 aa, Artificial Sequence
  ErbB3 binding MRD
ASEPYCPFINPTWKDECIARS

SEQ ID NO: 3952 - protein, 21 aa, Artificial Sequence
  ErbB3 binding MRD
HSEPYCPFLNPTWKEQCIARS

SEQ ID NO: 3953 - protein, 21 aa, Artificial Sequence
  ErbB3 binding MRD
MKEPYCPFLNPTWKAQCIART

SEQ ID NO: 3954 - protein, 21 aa, Artificial Sequence
  ErbB3 binding MRD
TDETYCPFKNPIWYEECIARS

SEQ ID NO: 3955 - protein, 21 aa, Artificial Sequence
  ErbB3 binding MRD
RGEPYCPFKNPTWKYQCLART

SEQ ID NO: 3956 - protein, 21 aa, Artificial Sequence
  ErbB3 binding MRD
IREPYCPFLNPIWKAHCIALT

SEQ ID NO: 3957 - protein, 21 aa, Artificial Sequence
  ErbB3 binding MRD
VSEPYCPFMNPIWKAECLSRT

SEQ ID NO: 3958 - protein, 21 aa, Artificial Sequence
  ErbB3 binding MRD
EREPYCPFLNPIWLEQCLSRT

SEQ ID NO: 3959 - protein, 21 aa, Artificial Sequence
  ErbB3 binding MRD
YSEPYCPFLNPIWKEQCIART

SEQ ID NO: 3960 - protein, 21 aa, Artificial Sequence
  ErbB3 binding MRD
FGEPYCPFLNPTWKAECLVRS

SEQ ID NO: 3961 - protein, 21 aa, Artificial Sequence
  ErbB3 binding MRD
LREPYCPFLNPTWKEQCLVRT

SEQ ID NO: 3962 - protein, 21 aa, Artificial Sequence
  ErbB3 binding MRD
STDPYCPFLNPVWNYQCIART

SEQ ID NO: 3963 - protein, 21 aa, Artificial Sequence
  ErbB3 binding MRD
SHEPYCPFQNPIWKAECLART

SEQ ID NO: 3964 - protein, 21 aa, Artificial Sequence
  ErbB3 binding MRD
LNDPYCPFLNPIWKEQCMSRY

SEQ ID NO: 3965 - protein, 21 aa, Artificial Sequence
  ErbB3 binding MRD
GYAPYCPFLNPIWKNECITRT

SEQ ID NO: 3966 - protein, 21 aa, Artificial Sequence
  ErbB3 binding MRD
FSEPYCPFVNPYWKEQCIART

SEQ ID NO: 3967 - protein, 21 aa, Artificial Sequence
  ErbB3 binding MRD
HTEPYCPFLNPTWKEQCLARF

SEQ ID NO: 3968 - protein, 21 aa, Artificial Sequence
  ErbB3 binding MRD
GYEPYCPFLNPIWKAECKARS

SEQ ID NO: 3969 - protein, 21 aa, Artificial Sequence
  ErbB3 binding MRD
LREAYCPFINPIWKDQCMARI

SEQ ID NO: 3970 - protein, 21 aa, Artificial Sequence
  ErbB3 binding MRD
LIEPYCPFLNPHWKAECIARY

SEQ ID NO: 3971 - protein, 21 aa, Artificial Sequence
  ErbB3 binding MRD
SSEPYCPFINPMWKDQCLART

SEQ ID NO: 3972 - protein, 21 aa, Artificial Sequence
  ErbB3 binding MRD
PSDPYCPFLNPSWKAECLART

SEQ ID NO: 3973 - protein, 21 aa, Artificial Sequence
  ErbB3 binding MRD
SSEPYCPFLNPIWKAECIARA

SEQ ID NO: 3974 - protein, 21 aa, Artificial Sequence
  ErbB3 binding MRD
FPEPYCPFLNPHWKAQCLERL

SEQ ID NO: 3975 - protein, 21 aa, Artificial Sequence
  ErbB3 binding MRD
FREPYCPFLNPTWKQQCLARI

SEQ ID NO: 3976 - protein, 21 aa, Artificial Sequence
  ErbB3 binding MRD
PREPYCPFLNPIWKDECIART

SEQ ID NO: 3977 - protein, 21 aa, Artificial Sequence
  ErbB3 binding MRD
MSDPYCPFLNPTWKAQCIART

SEQ ID NO: 3978 - protein, 21 aa, Artificial Sequence
  ErbB3 binding MRD
NSEPYCPFSNPTWKDECLIRS

SEQ ID NO: 3979 - protein, 21 aa, Artificial Sequence
  ErbB3 binding MRD
LREPYCPFLNPTWKEQCIARY

SEQ ID NO: 3980 - protein, 21 aa, Artificial Sequence
  ErbB3 binding MRD
HNKTYCPFLNPTWKAQCIART

SEQ ID NO: 3981 - protein, 21 aa, Artificial Sequence
  ErbB3 binding MRD
IGEPYCPFLNPTWKEECIRRT

SEQ ID NO: 3982 - protein, 21 aa, Artificial Sequence
  ErbB3 binding MRD
ISEPYCPFINPTWKAECIARS

SEQ ID NO: 3983 - protein, 21 aa, Artificial Sequence
  ErbB3 binding MRD
TKAPYCPFKNPIWKAECIART

SEQ ID NO: 3984 - protein, 21 aa, Artificial Sequence
  ErbB3 binding MRD
PGDPYCPFLNPIWKQECIVRN

SEQ ID NO: 3985 - protein, 21 aa, Artificial Sequence
  ErbB3 binding MRD
STEPYCPFSNPTWKAQCIARI

SEQ ID NO: 3986 - protein, 21 aa, Artificial Sequence
  ErbB3 binding MRD
RSEPYCPFLNPTWKDQCIARS

SEQ ID NO: 3987 - protein, 21 aa, Artificial Sequence
  ErbB3 binding MRD
SSEPYCPFLNPIWKEHCIART

SEQ ID NO: 3988 - protein, 21 aa, Artificial Sequence
  ErbB3 binding MRD
YREPYCPFLNPIWKEQCIART

SEQ ID NO: 3989 - protein, 21 aa, Artificial Sequence
  ErbB3 binding MRD
HSEPYCPFVNPTWYNECISRT

SEQ ID NO: 3990 - protein, 21 aa, Artificial Sequence
  ErbB3 binding MRD
RSEPYCPFLNPIWKDQCIARS

SEQ ID NO: 3991 - protein, 21 aa, Artificial Sequence
  ErbB3 binding MRD
VNEPYCPFLNPKWYAECLART

SEQ ID NO: 3992 - protein, 21 aa, Artificial Sequence
  ErbB3 binding MRD
QNDPYCPFLNPIWKAQCIARS

SEQ ID NO: 3993 - protein, 21 aa, Artificial Sequence
  ErbB3 binding MRD
SSEPYCPFLNPYWKEQCIART

SEQ ID NO: 3994 - protein, 21 aa, Artificial Sequence
  ErbB3 binding MRD
YREPYCPFLNPYWKDQCMART

SEQ ID NO: 3995 - protein, 21 aa, Artificial Sequence
  ErbB3 binding MRD
MHEPYCPFINPTWYEQCLARS

SEQ ID NO: 3996 - protein, 21 aa, Artificial Sequence
  ErbB3 binding MRD
QLKPYCPFLNPIWYDQCVSRT

SEQ ID NO: 3997 - protein, 21 aa, Artificial Sequence
  ErbB3 binding MRD
SSEPYCPFLNPSWKDQCIARL

SEQ ID NO: 3998 - protein, 21 aa, Artificial Sequence
  ErbB3 binding MRD
YIDPYCPFLNPTWKDACLARS

SEQ ID NO: 3999 - protein, 21 aa, Artificial Sequence
  ErbB3 binding MRD
SSEHYCPFVNPAWKEACIARY

SEQ ID NO: 4000 - protein, 21 aa, Artificial Sequence
  ErbB3 binding MRD
QSEPYCPFVNPTWKNECIARY

SEQ ID NO: 4001 - protein, 21 aa, Artificial Sequence
  ErbB3 binding MRD
LSDPYCPFLNPIWKDQCIART

SEQ ID NO: 4002 - protein, 21 aa, Artificial Sequence
  ErbB3 binding MRD
LGEPYCPFINPTWKAECLART

SEQ ID NO: 4003 - protein, 21 aa, Artificial Sequence
  ErbB3 binding MRD
YGDPYCPFLNPTWKENCIART

SEQ ID NO: 4004 - protein, 21 aa, Artificial Sequence
  ErbB3 binding MRD
LTEPYCPFLNPTWKDECLART

SEQ ID NO: 4005 - protein, 21 aa, Artificial Sequence
  ErbB3 binding MRD
FREPYCPFKNPTWLAQCIARS

SEQ ID NO: 4006 - protein, 21 aa, Artificial Sequence
  ErbB3 binding MRD
ANEPYCPFLNPHWKGQCVLRS

SEQ ID NO: 4007 - protein, 21 aa, Artificial Sequence
  ErbB3 binding MRD
LNEPYCPFNNPTWKEECIKRS

SEQ ID NO: 4008 - protein, 21 aa, Artificial Sequence
  ErbB3 binding MRD
QSEPYCPFLNPTWYTECVART

SEQ ID NO: 4009 - protein, 21 aa, Artificial Sequence
  ErbB3 binding MRD
SSQPYCPFLNPTWKDACLART

SEQ ID NO: 4010 - protein, 21 aa, Artificial Sequence
  ErbB3 binding MRD
SHEPYCPFLNPEWKAECIARN

SEQ ID NO: 4011 - protein, 21 aa, Artificial Sequence
  ErbB3 binding MRD
ASDPYCPFLNPIWKDQCILRS

SEQ ID NO: 4012 - protein, 21 aa, Artificial Sequence
  ErbB3 binding MRD
DNDPYCPFLNPTWKEECVARS

SEQ ID NO: 4013 - protein, 21 aa, Artificial Sequence
  ErbB3 binding MRD
ESEPYCPFVNPIWKDQCMARY

SEQ ID NO: 4014 - protein, 21 aa, Artificial Sequence
  ErbB3 binding MRD
LSAPYCPFLNPTWKDQCLART

SEQ ID NO: 4015 - protein, 21 aa, Artificial Sequence
  ErbB3 binding MRD
SSEPYCPFLNPIWKQACYDRT

SEQ ID NO: 4016 - protein, 21 aa, Artificial Sequence
  ErbB3 binding MRD
VDEPYCPFLNPNWKEACIARS

SEQ ID NO: 4017 - protein, 21 aa, Artificial Sequence
  ErbB3 binding MRD
LIEPYCPFLNPTWKEQCFVRS

SEQ ID NO: 4018 - protein, 21 aa, Artificial Sequence
  ErbB3 binding MRD
NDEPYCPFLNPIWKAQCLARN

SEQ ID NO: 4019 - protein, 21 aa, Artificial Sequence
  ErbB3 binding MRD
AGKPYCPFLNPSWYDECIRRL

SEQ ID NO: 4020 - protein, 21 aa, Artificial Sequence
  ErbB3 binding MRD
LSEPYCPFLNPIWKDQCMIRS

SEQ ID NO: 4021 - protein, 21 aa, Artificial Sequence
  ErbB3 binding MRD
STEPYCPFLNPTWKDQCIARI

SEQ ID NO: 4022 - protein, 21 aa, Artificial Sequence
  ErbB3 binding MRD
PREPYCPFLNPVWKAQCIARW

SEQ ID NO: 4023 - protein, 21 aa, Artificial Sequence
  ErbB3 binding MRD
ISAPYCPFKNPIWKAECIARS

SEQ ID NO: 4024 - protein, 21 aa, Artificial Sequence
  ErbB3 binding MRD
IGEPYCPFLNPTWKDQCLVRS

SEQ ID NO: 4025 - protein, 21 aa, Artificial Sequence
  ErbB3 binding MRD
SSVPYCPFKNPTWKAECIART

SEQ ID NO: 4026 - protein, 21 aa, Artificial Sequence
  ErbB3 binding MRD
YREPYCPFLNPLWKDECIART

SEQ ID NO: 4027 - protein, 21 aa, Artificial Sequence
  ErbB3 binding MRD
HSEPYCPFLNPTWKDECITRT

SEQ ID NO: 4028 - protein, 21 aa, Artificial Sequence
  ErbB3 binding MRD
YSDPYCPFLNPSWYDECVSRM

SEQ ID NO: 4029 - protein, 21 aa, Artificial Sequence
  ErbB3 binding MRD
YREPYCPFLNPTWYVECIARS

SEQ ID NO: 4030 - protein, 21 aa, Artificial Sequence
  ErbB3 binding MRD
HREPYCPFLNPAWKEQCLVRS

SEQ ID NO: 4031 - protein, 21 aa, Artificial Sequence
  ErbB3 binding MRD
ASEPYCPFLNPTWRDACLART

SEQ ID NO: 4032 - protein, 21 aa, Artificial Sequence
  ErbB3 binding MRD
LREPYCPFLNPTWKEQCIARS

SEQ ID NO: 4033 - protein, 21 aa, Artificial Sequence
  ErbB3 binding MRD
SSEPYCPFLNPTWYNECIYRI

SEQ ID NO: 4034 - protein, 21 aa, Artificial Sequence
  ErbB3 binding MRD
LREPYCPFENPIWKEKCIAIT

SEQ ID NO: 4035 - protein, 21 aa, Artificial Sequence
  ErbB3 binding MRD
PSEPYCPFLNPTWKAECIART

SEQ ID NO: 4036 - protein, 21 aa, Artificial Sequence
  ErbB3 binding MRD
ATEPYCPFLNPIWKAQCIERM

SEQ ID NO: 4037 - protein, 21 aa, Artificial Sequence
  ErbB3 binding MRD
LGEPYCPFLNPTWKLQCLART

SEQ ID NO: 4038 - protein, 21 aa, Artificial Sequence
  ErbB3 binding MRD
ATEPYCPFLNPVWKDQCILRT

SEQ ID NO: 4039 - protein, 21 aa, Artificial Sequence
  ErbB3 binding MRD
PIEPYCPFINPMWKAECIART

SEQ ID NO: 4040 - protein, 21 aa, Artificial Sequence
  ErbB3 binding MRD
GREPYCPFLNPVWYNECMVRF

SEQ ID NO: 4041 - protein, 21 aa, Artificial Sequence
  ErbB3 binding MRD
VIEPYCPFLNPIWKEQCIARS

SEQ ID NO: 4042 - protein, 21 aa, Artificial Sequence
  ErbB3 binding MRD
TIEPYCPFLNPTWYKECLLRS

SEQ ID NO: 4043 - protein, 21 aa, Artificial Sequence
  ErbB3 binding MRD
LGEPYCPFLNPTWKDQCTARS

SEQ ID NO: 4044 - protein, 21 aa, Artificial Sequence
  ErbB3 binding MRD
LNEPYCPFLNPIWKAQCIART

SEQ ID NO: 4045 - protein, 21 aa, Artificial Sequence
  ErbB3 binding MRD
WSEPYCPFLNPTWKAECIART

SEQ ID NO: 4046 - protein, 21 aa, Artificial Sequence
  ErbB3 binding MRD
ASEPYCPFWNPIWKAQCIARI

SEQ ID NO: 4047 - protein, 21 aa, Artificial Sequence
  ErbB3 binding MRD
ISEPYCPFVNPTWKAQCIART

SEQ ID NO: 4048 - protein, 21 aa, Artificial Sequence
  ErbB3 binding MRD
VIEPYCPFVNPTWKEQCILRS

SEQ ID NO: 4049 - protein, 18 aa, Artificial Sequence
  ErbB3 binding MRD
MSCDEAWYNEQTWLWCVT

SEQ ID NO: 4050 - protein, 20 aa, Artificial Sequence
  ErbB3 binding MRD
WQCEWQWVQEWGAWDEFCVM

SEQ ID NO: 4051 - protein, 20 aa, Artificial Sequence
  ErbB3 binding MRD
GYCATDYWDYNGVWGTYCTQ

SEQ ID NO: 4052 - protein, 18 aa, Artificial Sequence
  ErbB3 binding MRD
RYCYLFEKYAPFYDQCLL

SEQ ID NO: 4053 - protein, 18 aa, Artificial Sequence
  ErbB3 binding MRD
RYCYLFQKYAPFYDQCLL

SEQ ID NO: 4054 - protein, 18 aa, Artificial Sequence
  ErbB3 binding MRD
GCCYWWGLVYDKWIKCET

SEQ ID NO: 4055 - protein, 20 aa, Artificial Sequence
  ErbB3 binding MRD
YQVKCPFQNPVWWSHCMYLL

SEQ ID NO: 4056 - protein, 18 aa, Artificial Sequence
  ErbB3 binding MRD
GYCFLFYKFPQYHMQCII

SEQ ID NO: 4057 - protein, 20 aa, Artificial Sequence
  ErbB3 binding MRD
KECLFTVPGVQHPVMWYCLT

SEQ ID NO: 4058 - protein, 18 aa, Artificial Sequence
  ErbB3 binding MRD
LLCRGQTANNLQPDECLT

SEQ ID NO: 4059 - protein, 18 aa, Artificial Sequence
  ErbB3 binding MRD
TCCRDYWMYRFLYTQCGM

SEQ ID NO: 4060 - protein, 17 aa, Artificial Sequence
  ErbB3 binding MRD
SFHRCFEWVRHNCVWGA

SEQ ID NO: 4061 - protein, 19 aa, Artificial Sequence
  ErbB3 binding MRD
ETLACAKLMPWYNECLARF

SEQ ID NO: 4062 - protein, 18 aa, Artificial Sequence
  ErbB3 binding MRD
RYCDHFVNHHDYYKLCLT

SEQ ID NO: 4063 - protein, 20 aa, Artificial Sequence
  ErbB3 binding MRD
WQCEWQWVQEWGAWDKFCVM

SEQ ID NO: 4064 - protein, 17 aa, Artificial Sequence
  ErbB3 binding MRD
LERLCIEIWSYHCRSFL

SEQ ID NO: 4065 - protein, 17 aa, Artificial Sequence
  ErbB3 binding MRD
LATWCQRWLASACFGLF

SEQ ID NO: 4066 - protein, 20 aa, Artificial Sequence
  ErbB3 binding MRD
GWCFEYYPEVSRFVYSDCNS

SEQ ID NO: 4067 - protein, 20 aa, Artificial Sequence
  ErbB3 binding MRD
YQVKCPFQNPVWWTHCMYLL

SEQ ID NO: 4068 - protein, 20 aa, Artificial Sequence
  ErbB3 binding MRD
WHCQWFWVPEWGAWDEFCVM

SEQ ID NO: 4069 - protein, 20 aa, Artificial Sequence
  ErbB3 binding MRD
STCLLQYYQFDVFSKKFCPL

SEQ ID NO: 4070 - protein, 20 aa, Artificial Sequence
  ErbB3 binding MRD
WHCEWHWVQEWGAWDEFCVM

SEQ ID NO: 4071 - protein, 20 aa, Artificial Sequence
  ErbB3 binding MRD
PKVRCPFQNPIWWSHCMEIL

SEQ ID NO: 4072 - protein, 18 aa, Artificial Sequence
  ErbB3 binding MRD
SVCHKMWPIIDDLYYCLR

SEQ ID NO: 4073 - protein, 18 aa, Artificial Sequence
  ErbB3 binding MRD
SLCQHFQQQPVWYQACIR

SEQ ID NO: 4074 - protein, 20 aa, Artificial Sequence
  ErbB3 binding MRD
YQVRCPFQNPVWWSHCMYLL

SEQ ID NO: 4075 - protein, 18 aa, Artificial Sequence
  ErbB3 binding MRD
GYCFLFYKFPQYHMQCIS

SEQ ID NO: 4076 - protein, 18 aa, Artificial Sequence
  ErbB3 binding MRD
LLCRGQSANNLQRDECLR

SEQ ID NO: 4077 - protein, 20 aa, Artificial Sequence
  ErbB3 binding MRD
WHCQWFWVHEWGAWNEFCVM

SEQ ID NO: 4078 - protein, 20 aa, Artificial Sequence
  ErbB3 binding MRD
WQCEWEWVQEWGAWDEFCVM

SEQ ID NO: 4079 - protein, 20 aa, Artificial Sequence
  ErbB3 binding MRD
DQVKCPFQNPVWWSHCMYLL

SEQ ID NO: 4080 - protein, 20 aa, Artificial Sequence
  ErbB3 binding MRD
WHCEWQWVQEWGAWDEFCVM

SEQ ID NO: 4081 - protein, 20 aa, Artificial Sequence
  ErbB3 binding MRD
PKVRCPFQNPIWWSHCMKIL

SEQ ID NO: 4082 - protein, 20 aa, Artificial Sequence
  ErbB3 binding MRD
GRCRGYEVDPWWHAPCFCDL

SEQ ID NO: 4083 - protein, 18 aa, Artificial Sequence
  ErbB3 binding MRD
ILCQHFQQQPVWYQACIR

SEQ ID NO: 4084 - protein, 21 aa, Artificial Sequence
  ErbB3 binding MRD
WNEPYCPFLNPTWKAQCIARI

SEQ ID NO: 4085 - protein, 21 aa, Artificial Sequence
  ErbB3 binding MRD
LGEPYCPFLNPFWYDQCIARN

SEQ ID NO: 4086 - protein, 21 aa, Artificial Sequence
  ErbB3 binding MRD
LGEPYCPFLNPYWYDQCMSRT

SEQ ID NO: 4087 - protein, 52 aa, Artificial Sequence
  ErbB3 binding MRD
ASSETYCPFLNPYWYDQCMSRTSGGGSGGGSQAAAGGSYMHEPHMQVLEIMN

SEQ ID NO: 4088 - protein, 21 aa, Artificial Sequence
  EGC1077
SSETYCPFLNPYWYDQCMSRT

SEQ ID NO: 4089 - protein, 20 aa, Artificial Sequence
  EGC180
SEPYCPFLNPTWKSQCIART

SEQ ID NO: 4090 - protein, 20 aa, Artificial Sequence
  EGC42
SQVSCPFQNPIWWSHCMELM

SEQ ID NO: 4091 - protein, 21 aa, Artificial Sequence
  EGC593
GSKPYCPFTNPIWYDECIKRS

SEQ ID NO: 4092 - protein, 21 aa, Artificial Sequence
  EGC503
ATEPYCPFLNPIWKAECLARS

SEQ ID NO: 4093 - protein, 20 aa, Artificial Sequence
  EGC41
KFLMCQVYPSEKWHVCVETL

SEQ ID NO: 4094 - protein, 49 aa, Artificial Sequence
  EGC1086
SKPYCPFTNPIWYDECIKRSGGGSGGGSQAAAGGSYMHEPHMQVLEIMN

SEQ ID NO: 4095 - protein, 18 aa, Artificial Sequence
  ErbB4 binding MRD
HPWRCLKKPEVVQCLRTG

SEQ ID NO: 4096 - protein, 18 aa, Artificial Sequence
  ErbB4 binding MRD
GIFACVKEPEVVKCLISW

SEQ ID NO: 4097 - protein, 18 aa, Artificial Sequence
  ErbB4 binding MRD
HPWRCLEEPEVVQCLRTG

SEQ ID NO: 4098 - protein, 19 aa, Artificial Sequence
  ErbB4 binding MRD
EERLCYTPEAIFVDCTLHF

SEQ ID NO: 4099 - protein, 16 aa, Artificial Sequence
  ErbB4 binding MRD
SRADWCDWHKCVVLQW

SEQ ID NO: 4100 - protein, 16 aa, Artificial Sequence
  ErbB4 binding MRD
AYADWCSWHQCVQLDS

SEQ ID NO: 4101 - protein, 15 aa, Artificial Sequence
  ErbB4 binding MRD
SVLVCWMYDQCVSVS

SEQ ID NO: 4102 - protein, 18 aa, Artificial Sequence
  ErbB4 binding MRD
HRWRCLIEPEVVQCLRTG

SEQ ID NO: 4103 - protein, 18 aa, Artificial Sequence
  ErbB4 binding MRD
ADGHCWMYYEDWMCLYLM

SEQ ID NO: 4104 - protein, 15 aa, Artificial Sequence
  ErbB4 binding MRD
SGWHCWVDYFCTRVE

SEQ ID NO: 4105 - protein, 19 aa, Artificial Sequence
  ErbB4 binding MRD
VGAFCLPFEYWYQDCTRRL

SEQ ID NO: 4106 - protein, 18 aa, Artificial Sequence
  ErbB4 binding MRD
PVETCMNYYEDIICRFLV

SEQ ID NO: 4107 - protein, 18 aa, Artificial Sequence
  ErbB4 binding MRD
WKDFCPDVPPWLACTGSS

SEQ ID NO: 4108 - protein, 18 aa, Artificial Sequence
  ErbB4 binding MRD
FPFSCVMRPHVIECLLSG

SEQ ID NO: 4109 - protein, 18 aa, Artificial Sequence
  ErbB4 binding MRD
ADGHCWMYYQDWMCLYLM

SEQ ID NO: 4110 - protein, 17 aa, Artificial Sequence
  ErbB4 binding MRD
EQLNCQEKIQYWCTRIY

SEQ ID NO: 4111 - protein, 15 aa, Artificial Sequence
  ErbB4 binding MRD
AYADWCSCINASSWT

SEQ ID NO: 4112 - protein, 16 aa, Artificial Sequence
  ErbB4 binding MRD
AYTDWCSWHRCVQLDS

SEQ ID NO: 4113 - protein, 18 aa, Artificial Sequence
  ErbB4 binding MRD
YLIMCKEFPWSFTCGTLY

SEQ ID NO: 4114 - protein, 16 aa, Artificial Sequence
  ErbB4 binding MRD
DNSGCNAPTFVCGFLW

SEQ ID NO: 4115 - protein, 18 aa, Artificial Sequence
  ErbB4 binding MRD
SPFLCVHDFQVIECLIRW

SEQ ID NO: 4116 - protein, 16 aa, Artificial Sequence
  ErbB4 binding MRD
QDNCCFIIIDNCQSGF

SEQ ID NO: 4117 - protein, 19 aa, Artificial Sequence
  ErbB4 binding MRD
SVGRCFSHMPYHVSCSVSV

SEQ ID NO: 4118 - protein, 18 aa, Artificial Sequence
  ErbB4 binding MRD
GWPPCADWMDQQLCSSAL

SEQ ID NO: 4119 - protein, 15 aa, Artificial Sequence
  ErbB4 binding MRD
LKYRCVIYFHCYGWM

SEQ ID NO: 4120 - protein, 18 aa, Artificial Sequence
  ErbB4 binding MRD
SQNVCLHLPWGWECFAWP

SEQ ID NO: 4121 - protein, 16 aa, Artificial Sequence
  ErbB4 binding MRD
KPWRTCFNHGCELSLR

SEQ ID NO: 4122 - protein, 15 aa, Artificial Sequence
  ErbB4 binding MRD
  misc_feature (9)..(9): Xaa can be any naturally occurring amino acid
SRADWCDWXNASSCS

SEQ ID NO: 4123 - protein, 17 aa, Artificial Sequence
  ErbB4 binding MRD
EGPPCYDWWTSSCARVR

SEQ ID NO: 4124 - protein, 18 aa, Artificial Sequence
  ErbB4 binding MRD
ADGHCWMYYEYWMCLYLM

SEQ ID NO: 4125 - protein, 15 aa, Artificial Sequence
  TNFRSF10B (DR5) binding MRD
VSDTCMVIMTCRYSP

SEQ ID NO: 4126 - protein, 20 aa, Artificial Sequence
  TNFRSF10B (DR5) binding MRD
SERICFKIYMTSKNTCQKAS

SEQ ID NO: 4127 - protein, 17 aa, Artificial Sequence
  TNFRSF10B (DR5) binding MRD
ALRPCLVYMSMKCSVTW

SEQ ID NO: 4128 - protein, 15 aa, Artificial Sequence
  TNFRSF10B (DR5) binding MRD
SLTPCVYLTMCAPGH

SEQ ID NO: 4129 - protein, 15 aa, Artificial Sequence
  TNFRSF10B (DR5) binding MRD
DVGECRVIMTCRPSS

SEQ ID NO: 4130 - protein, 15 aa, Artificial Sequence
  TNFRSF10B (DR5) binding MRD
QQGSCKIYMTCRYSH

SEQ ID NO: 4131 - protein, 20 aa, Artificial Sequence
  TNFRSF10B (DR5) binding MRD
QWQVCYWTEGRWADSCGWAQ

SEQ ID NO: 4132 - protein, 15 aa, Artificial Sequence
  TNFRSF10B (DR5) binding MRD
SVYPCKVIMTCLRSP

SEQ ID NO: 4133 - protein, 16 aa, Artificial Sequence
  TNFRSF10B (DR5) binding MRD
TGNICKRPVLTCNWSG

SEQ ID NO: 4134 - protein, 15 aa, Artificial Sequence
  TNFRSF10B (DR5) binding MRD
TEFGCQVYMTCRPKL

SEQ ID NO: 4135 - protein, 15 aa, Artificial Sequence
  TNFRSF10B (DR5) binding MRD
SVYPCKVIMTCLKSP

SEQ ID NO: 4136 - protein, 17 aa, Artificial Sequence
  TNFRSF10B (DR5) binding MRD
NFRMCIPIMTMHCWADD

SEQ ID NO: 4137 - protein, 16 aa, Artificial Sequence
  TNFRSF10B (DR5) binding MRD
DQYTCDRVILTCWTPH

SEQ ID NO: 4138 - protein, 15 aa, Artificial Sequence
  TNFRSF10B (DR5) binding MRD
RVSECFLYLTCHKGQ

SEQ ID NO: 4139 - protein, 17 aa, Artificial Sequence
  TNFRSF10B (DR5) binding MRD
PTRECTVILTQHCWNVW

SEQ ID NO: 4140 - protein, 14 aa, Artificial Sequence
  TNFRSF10B (DR5) binding MRD
LTPCQPIMTCKRPV

SEQ ID NO: 4141 - protein, 15 aa, Artificial Sequence
  TNFRSF10B (DR5) binding MRD
SPSPCKVIMTCAPLN

SEQ ID NO: 4142 - protein, 15 aa, Artificial Sequence
  TNFRSF10B (DR5) binding MRD
ARHPHEPPYLCMKCL

SEQ ID NO: 4143 - protein, 17 aa, Artificial Sequence
  TNFRSF10B (DR5) binding MRD
ANDRCIPIMHWHCWAYW

SEQ ID NO: 4144 - protein, 16 aa, Artificial Sequence
  TNFRSF10B (DR5) binding MRD
VQGGCDLVILTCKMWG

SEQ ID NO: 4145 - protein, 17 aa, Artificial Sequence
  TNFRSF10B (DR5) binding MRD
LRDFCSTTMAHQCHFGP

SEQ ID NO: 4146 - protein, 15 aa, Artificial Sequence
  TNFRSF10B (DR5) binding MRD
AKGECQVYLTCRYNS

SEQ ID NO: 4147 - protein, 17 aa, Artificial Sequence
  TNFRSF10B (DR5) binding MRD
GSEGCKVILTMKCPDRI

SEQ ID NO: 4148 - protein, 20 aa, Artificial Sequence
  TNFRSF10B (DR5) binding MRD
EYVECGPHQYYWFGHCHFWA

SEQ ID NO: 4149 - protein, 12 aa, Artificial Sequence
  TNFRSF10B (DR5) binding MRD
KCNFNPWKAACG

SEQ ID NO: 4150 - protein, 17 aa, Artificial Sequence
  TNFRSF10B (DR5) binding MRD
YAERCKVYLTMKCDISQ

SEQ ID NO: 4151 - protein, 17 aa, Artificial Sequence
  TNFRSF10B (DR5) binding MRD
PSEMCVVVMRNYCWSST

SEQ ID NO: 4152 - protein, 17 aa, Artificial Sequence
  TNFRSF10B (DR5) binding MRD
LSSGCMVYMTMKCGSTK

SEQ ID NO: 4153 - protein, 15 aa, Artificial Sequence
  TNFRSF10B (DR5) binding MRD
VGADCWVIMTCRKNL

SEQ ID NO: 4154 - protein, 15 aa, Artificial Sequence
  TNFRSF10B (DR5) binding MRD
ATTPCMVYMTCFRTP

SEQ ID NO: 4155 - protein, 17 aa, Artificial Sequence
  TNFRSF10B (DR5) binding MRD
QDRACFPIMTLHCPGEG

SEQ ID NO: 4156 - protein, 18 aa, Artificial Sequence
  TNFRSF10B (DR5) binding MRD
QTRNCGVWPNHLVCMPLS

SEQ ID NO: 4157 - protein, 15 aa, Artificial Sequence
  TNFRSF10B (DR5) binding MRD
LQKVCAAWYYCMESH

SEQ ID NO: 4158 - protein, 17 aa, Artificial Sequence
  TNFRSF10B (DR5) binding MRD
LRANCKVVLTERCGNYL

SEQ ID NO: 4159 - protein, 15 aa, Artificial Sequence
  TNFRSF10B (DR5) binding MRD
ADEACLVVLTCRASP

SEQ ID NO: 4160 - protein, 19 aa, Artificial Sequence
  TNFRSF10B (DR5) binding MRD
SGLGCPQNHLLVLTCRHAM

SEQ ID NO: 4161 - protein, 17 aa, Artificial Sequence
  TNFRSF10B (DR5) binding MRD
WIAGCKLVLTERCLNYF

SEQ ID NO: 4162 - protein, 17 aa, Artificial Sequence
  TNFRSF10B (DR5) binding MRD
NNSQCQVILTHRCHSLT

SEQ ID NO: 4163 - protein, 17 aa, Artificial Sequence
  TNFRSF10B (DR5) binding MRD
KVSVCFPILTMYCSERY

SEQ ID NO: 4164 - protein, 17 aa, Artificial Sequence
  TNFRSF10B (DR5) binding MRD
NDLMCQPIMTMKCARYQ

SEQ ID NO: 4165 - protein, 16 aa, Artificial Sequence
  TNFRSF10B (DR5) binding MRD
ILIFCQTPPHHCLSKL

SEQ ID NO: 4166 - protein, 17 aa, Artificial Sequence
  TNFRSF10B (DR5) binding MRD
SYQRCKVIMTQKCIVPP

SEQ ID NO: 4167 - protein, 15 aa, Artificial Sequence
  TNFRSF10B (DR5) binding MRD
TSDRCVVVLTCRMWG

SEQ ID NO: 4168 - protein, 17 aa, Artificial Sequence
  TNFRSF10B (DR5) binding MRD
HVSRCEPVLTMHCWRGS

SEQ ID NO: 4169 - protein, 15 aa, Artificial Sequence
  TNFRSF10B (DR5) binding MRD
PSYPCSIILTCRSTL

SEQ ID NO: 4170 - protein, 15 aa, Artificial Sequence
  TNFRSF10B (DR5) binding MRD
RDSECFIYLTCRVLP

SEQ ID NO: 4171 - protein, 15 aa, Artificial Sequence
  TNFRSF10B (DR5) binding MRD
SAEDCFVILTCLCSR

SEQ ID NO: 4172 - protein, 15 aa, Artificial Sequence
  TNFRSF10B (DR5) binding MRD
DRYPCYFYLTCIPAS

SEQ ID NO: 4173 - protein, 15 aa, Artificial Sequence
  TNFRSF10B (DR5) binding MRD
LQSECFVIMTCKRVN

SEQ ID NO: 4174 - protein, 15 aa, Artificial Sequence
  TNFRSF10B (DR5) binding MRD
NTKPCMPIMTCLKWN

SEQ ID NO: 4175 - protein, 15 aa, Artificial Sequence
  TNFRSF10B (DR5) binding MRD
WNTPCMVIMTCRPHE

SEQ ID NO: 4176 - protein, 15 aa, Artificial Sequence
  TNFRSF10B (DR5) binding MRD
PLTKCKVIMTCARGI

SEQ ID NO: 4177 - protein, 15 aa, Artificial Sequence
  TNFRSF10B (DR5) binding MRD
WHYPCQPVLTCRSHN

SEQ ID NO: 4178 - protein, 15 aa, Artificial Sequence
  TNFRSF10B (DR5) binding MRD
FQTECLVYMTCRTIY

SEQ ID NO: 4179 - protein, 15 aa, Artificial Sequence
  TNFRSF10B (DR5) binding MRD
WESPCFIKLTCHMVA

SEQ ID NO: 4180 - protein, 16 aa, Artificial Sequence
  TNFRSF10B (DR5) binding MRD
FVGHCWWPLGLCAPLP

SEQ ID NO: 4181 - protein, 15 aa, Artificial Sequence
  TNFRSF10B (DR5) binding MRD
SSMSCVEYQQCRLGY

SEQ ID NO: 4182 - protein, 15 aa, Artificial Sequence
  TNFRSF10B (DR5) binding MRD
ARDSCLVYMTCRPVA

SEQ ID NO: 4183 - protein, 17 aa, Artificial Sequence
  TNFRSF10B (DR5) binding MRD
LNASCMVYLTQRCSHTS

SEQ ID NO: 4184 - protein, 16 aa, Artificial Sequence
  TNFRSF10B (DR5) binding MRD
RHDGCNKIMLTCHTRA

SEQ ID NO: 4185 - protein, 15 aa, Artificial Sequence
  TNFRSF10B (DR5) binding MRD
HRDPCTVVLTCRSLS

SEQ ID NO: 4186 - protein, 16 aa, Artificial Sequence
  TNFRSF10B (DR5) binding MRD
MTSECQKVILTCWNAS

SEQ ID NO: 4187 - protein, 18 aa, Artificial Sequence
  TNFRSF10B (DR5) binding MRD
YMSVCHIDGHQVVCLKNK

SEQ ID NO: 4188 - protein, 17 aa, Artificial Sequence
  TNFRSF10B (DR5) binding MRD
SGDTCLVILTHRCATVS

SEQ ID NO: 4189 - protein, 15 aa, Artificial Sequence
  TNFRSF10B (DR5) binding MRD
YTAPCKVYMTCVRPM

SEQ ID NO: 4190 - protein, 17 aa, Artificial Sequence
  TNFRSF10B (DR5) binding MRD
LRANCKVVLTERCCNYL

SEQ ID NO: 4191 - protein, 15 aa, Artificial Sequence
  TNFRSF10B (DR5) binding MRD
PPSSCQVILTCRPIW

SEQ ID NO: 4192 - protein, 18 aa, Artificial Sequence
  TNFRSF10B (DR5) binding MRD
LSTRCTDQDIVLTCRIKD

SEQ ID NO: 4193 - protein, 15 aa, Artificial Sequence
  TNFRSF10B (DR5) binding MRD
WHYPCQPVLTCRSRT

SEQ ID NO: 4194 - protein, 15 aa, Artificial Sequence
  TNFRSF10B (DR5) binding MRD
GQTDCMIIMTCKQWK

SEQ ID NO: 4195 - protein, 17 aa, Artificial Sequence
  TNFRSF10B (DR5) binding MRD
PATRCEPVLRHFCWGQG

SEQ ID NO: 4196 - protein, 18 aa, Artificial Sequence
  TNFRSF10B (DR5) binding MRD
DSFGCTWEVWGRECHPQL

SEQ ID NO: 4197 - protein, 18 aa, Artificial Sequence
  TNFRSF10B (DR5) binding MRD
FYLYCPYPEMSSHCVLRA

SEQ ID NO: 4198 - protein, 17 aa, Artificial Sequence
  TNFRSF10B (DR5) binding MRD
LRADCKVVLTERCSNYL

SEQ ID NO: 4199 - protein, 15 aa, Artificial Sequence
  TNFRSF10B (DR5) binding MRD
HENPCQVYMTCRHLD

SEQ ID NO: 4200 - protein, 15 aa, Artificial Sequence
  TNFRSF10B (DR5) binding MRD
SAEECFVILTCLGSR

SEQ ID NO: 4201 - protein, 17 aa, Artificial Sequence
  TNFRSF10B (DR5) binding MRD
ARQDCVPVMRWHCWAEI

SEQ ID NO: 4202 - protein, 16 aa, Artificial Sequence
  TNFRSF10B (DR5) binding MRD
PPLGCTRIALTCWDIR

SEQ ID NO: 4203 - protein, 17 aa, Artificial Sequence
  TNFRSF10B (DR5) binding MRD
QPPECRVIMTLRCGDAW

SEQ ID NO: 4204 - protein, 17 aa, Artificial Sequence
  TNFRSF10B (DR5) binding MRD
PKQACKIIMTERCWAVD

SEQ ID NO: 4205 - protein, 15 aa, Artificial Sequence
  TNFRSF10B (DR5) binding MRD
TVGECMPIMTCFSTN

SEQ ID NO: 4206 - protein, 15 aa, Artificial Sequence
  TNFRSF10B (DR5) binding MRD
WHYPCQPVLTCRSHT

SEQ ID NO: 4207 - protein, 15 aa, Artificial Sequence
  TNFRSF10B (DR5) binding MRD
PLTKCKVIMTCAWGI

SEQ ID NO: 4208 - protein, 17 aa, Artificial Sequence
  TNFRSF10B (DR5) binding MRD
GISGCKLVLTQRCLHVN

SEQ ID NO: 4209 - protein, 17 aa, Artificial Sequence
  TNFRSF10B (DR5) binding MRD
ERQGCVVYLTERCVVGR

SEQ ID NO: 4210 - protein, 17 aa, Artificial Sequence
  TNFRSF10B (DR5) binding MRD
NNSQCQVILTHHCHSLT

SEQ ID NO: 4211 - protein, 15 aa, Artificial Sequence
  TNFRSF10B (DR5) binding MRD
DKSPCQVVMTCRPLL

SEQ ID NO: 4212 - protein, 17 aa, Artificial Sequence
  TNFRSF10B (DR5) binding MRD
ALHKCMVILTNRCETPV

SEQ ID NO: 4213 - protein, 17 aa, Artificial Sequence
  TNFRSF10B (DR5) binding MRD
TTTSCKLYLTSTCSPNH

SEQ ID NO: 4214 - protein, 15 aa, Artificial Sequence
  TNFRSF10B (DR5) binding MRD
TEYPCKVYMTCMWPI

SEQ ID NO: 4215 - protein, 17 aa, Artificial Sequence
  TNFRSF10B (DR5) binding MRD
LGPNCKIVLTERCGNSL

SEQ ID NO: 4216 - protein, 18 aa, Artificial Sequence
  TNFRSF10B (DR5) binding MRD
SERPCGERPVVMTCFPVR

SEQ ID NO: 4217 - protein, 23 aa, Artificial Sequence
  TNFRSF10B (DR5) binding MRD
GSFSMRWDCGDNPIPGRRQCVIM

SEQ ID NO: 4218 - protein, 23 aa, Artificial Sequence
  TNFRSF10B (DR5) binding MRD
GSAQLLWDCGDNPIMGRRQCVKL

SEQ ID NO: 4219 - protein, 23 aa, Artificial Sequence
  TNFRSF10B (DR5) binding MRD
GSYTHTFDCGDFNITGRRQCVKL

SEQ ID NO: 4220 - protein, 23 aa, Artificial Sequence
  TNFRSF10B (DR5) binding MRD
GSLSSQFDCGENPILGRRQCLYL

SEQ ID NO: 4221 - protein, 23 aa, Artificial Sequence
  TNFRSF10B (DR5) binding MRD
GSRAQIWDCGDNPIRGQRQCVKL

SEQ ID NO: 4222 - protein, 23 aa, Artificial Sequence
  TNFRSF10B (DR5) binding MRD
GSIHIPPRCTEEDVIMTCRRSAD

SEQ ID NO: 4223 - protein, 23 aa, Artificial Sequence
  TNFRSF10B (DR5) binding MRD
GSSTFPRFCAEEDVIMTCRWRFD

SEQ ID NO: 4224 - protein, 23 aa, Artificial Sequence
  TNFRSF10B (DR5) binding MRD
GSNAIPRHCTEEDVIMTCRLRPS

SEQ ID NO: 4225 - protein, 23 aa, Artificial Sequence
  TNFRSF10B (DR5) binding MRD
GSAEFHRPCGEEDVIMTCRWRVH

SEQ ID NO: 4226 - protein, 23 aa, Artificial Sequence
  TNFRSF10B (DR5) binding MRD
GSNALPRACDERDVIMTCRKSVA

SEQ ID NO: 4227 - protein, 23 aa, Artificial Sequence
  TNFRSF10B (DR5) binding MRD
GSYDFPRTCAEEDVIMTCKWRIS

SEQ ID NO: 4228 - protein, 23 aa, Artificial Sequence
  TNFRSF10B (DR5) binding MRD
GSIPSRFDCGENPIAGRRQCVEL

SEQ ID NO: 4229 - protein, 23 aa, Artificial Sequence
  TNFRSF10B (DR5) binding MRD
GSQYIHMDCFENRIRGYCHCIKM

SEQ ID NO: 4230 - protein, 23 aa, Artificial Sequence
  TNFRSF10B (DR5) binding MRD
GSILIPRTCAQEDVIMTCRERAY

SEQ ID NO: 4231 - protein, 23 aa, Artificial Sequence
  TNFRSF10B (DR5) binding MRD
GSQGLPRPCGEEDVIMTCRWSGY

SEQ ID NO: 4232 - protein, 23 aa, Artificial Sequence
  TNFRSF10B (DR5) binding MRD
GSDSFTRTCTEDAVIMTCKWRVL

SEQ ID NO: 4233 - protein, 23 aa, Artificial Sequence
  TNFRSF10B (DR5) binding MRD
GSDPSPRTCAEEDVIMTCRWQVY

SEQ ID NO: 4234 - protein, 23 aa, Artificial Sequence
  TNFRSF10B (DR5) binding MRD
GSSMITRPCAEEDVIMTCKWLPI

SEQ ID NO: 4235 - protein, 23 aa, Artificial Sequence
  TNFRSF10B (DR5) binding MRD
GSGYNPRLCSEQDVIMTCRLRFG

SEQ ID NO: 4236 - protein, 23 aa, Artificial Sequence
  TNFRSF10B (DR5) binding MRD
GSFDRNWDCGDNPIKGRRQCVKV

SEQ ID NO: 4237 - protein, 23 aa, Artificial Sequence
  TNFRSF10B (DR5) binding MRD
GSTYMQFDCGDNPIPGRRQCVPL

SEQ ID NO: 4238 - protein, 23 aa, Artificial Sequence
  TNFRSF10B (DR5) binding MRD
GSFVSHWDCGENPIIGRRQCVLL

SEQ ID NO: 4239 - protein, 23 aa, Artificial Sequence
  TNFRSF10B (DR5) binding MRD
GSPPHSRPCAEEDVIMTCRYRIY

SEQ ID NO: 4240 - protein, 23 aa, Artificial Sequence
  TNFRSF10B (DR5) binding MRD
GSLDRPRPCAEEDVIMTCRWRAA

SEQ ID NO: 4241 - protein, 23 aa, Artificial Sequence
  TNFRSF10B (DR5) binding MRD
GSWKWSPTCAEEDVIMTCRKHVK

SEQ ID NO: 4242 - protein, 23 aa, Artificial Sequence
  TNFRSF10B (DR5) binding MRD
GSKSVPRLCSEEDVIMTCKRGVF

SEQ ID NO: 4243 - protein, 23 aa, Artificial Sequence
  TNFRSF10B (DR5) binding MRD
GSEYWQPPCAEEDVIMTCKWRVV

SEQ ID NO: 4244 - protein, 23 aa, Artificial Sequence
  TNFRSF10B (DR5) binding MRD
GSLCLPRHCAENEVIMTCRPLMF

SEQ ID NO: 4245 - protein, 23 aa, Artificial Sequence
  TNFRSF10B (DR5) binding MRD
GSLMSQWDCGDNPILGRRQCVKL

SEQ ID NO: 4246 - protein, 23 aa, Artificial Sequence
  TNFRSF10B (DR5) binding MRD
GSFKTIWDCGDNPIPGRRMCVKL

SEQ ID NO: 4247 - protein, 23 aa, Artificial Sequence
  TNFRSF10B (DR5) binding MRD
GSSSITWDCGDNPIPGRRQCVIH

SEQ ID NO: 4248 - protein, 23 aa, Artificial Sequence
  TNFRSF10B (DR5) binding MRD
GSPRFKWDCGDNPIAGRRQCVLL

SEQ ID NO: 4249 - protein, 23 aa, Artificial Sequence
  TNFRSF10B (DR5) binding MRD
GSSGFPHHCGEEDVIMTCRWRGL

SEQ ID NO: 4250 - protein, 23 aa, Artificial Sequence
  TNFRSF10B (DR5) binding MRD
GSPHFPRPCAEEDVIMTCRWRVI

SEQ ID NO: 4251 - protein, 23 aa, Artificial Sequence
  TNFRSF10B (DR5) binding MRD
GSGWHTRFCAEEDVIMTCKWRVI

SEQ ID NO: 4252 - protein, 23 aa, Artificial Sequence
  TNFRSF10B (DR5) binding MRD
GSDHWRRSCSEDDVIMTCRWRVS

SEQ ID NO: 4253 - protein, 23 aa, Artificial Sequence
  TNFRSF10B (DR5) binding MRD
GSFKVPHLCAEEDVIMTCRWRVY

SEQ ID NO: 4254 - protein, 23 aa, Artificial Sequence
  TNFRSF10B (DR5) binding MRD
GSRSSPHPCGEEDVIMTCRWRIT

SEQ ID NO: 4255 - protein, 23 aa, Artificial Sequence
  TNFRSF10B (DR5) binding MRD
GSVLQVCDCLDIPVFGTCQCVQL

SEQ ID NO: 4256 - protein, 23 aa, Artificial Sequence
  TNFRSF10B (DR5) binding MRD
GSGDSHWDCGDNPILGRRQCVKL

SEQ ID NO: 4257 - protein, 23 aa, Artificial Sequence
  TNFRSF10B (DR5) binding MRD
GSTSMLWDCGANPIKGRRQCVLL

SEQ ID NO: 4258 - protein, 23 aa, Artificial Sequence
  TNFRSF10B (DR5) binding MRD
GSMPYSWDCGDNPIVGRRQCVKV

SEQ ID NO: 4259 - protein, 23 aa, Artificial Sequence
  TNFRSF10B (DR5) binding MRD
GSFTSRWDCGNNLVIGQRQCIKL

SEQ ID NO: 4260 - protein, 23 aa, Artificial Sequence
  TNFRSF10B (DR5) binding MRD
GSSAPGFDCGDNPIVGQRQCIKL

SEQ ID NO: 4261 - protein, 23 aa, Artificial Sequence
  TNFRSF10B (DR5) binding MRD
GSMVGQRPCAEEDVIMTCRWRVV

SEQ ID NO: 4262 - protein, 23 aa, Artificial Sequence
  TNFRSF10B (DR5) binding MRD
GSSLLPRNCSEEDVIMTCRWRVD

SEQ ID NO: 4263 - protein, 23 aa, Artificial Sequence
  TNFRSF10B (DR5) binding MRD
GSGTTPRRCAEEDVIMTCRWSAH

SEQ ID NO: 4264 - protein, 23 aa, Artificial Sequence
  TNFRSF10B (DR5) binding MRD
GSSYSPRPCAEEDVIMTCRPRFH

SEQ ID NO: 4265 - protein, 23 aa, Artificial Sequence
  TNFRSF10B (DR5) binding MRD
GSGVFPRPCHEEDVIMTCRWRVH

SEQ ID NO: 4266 - protein, 23 aa, Artificial Sequence
  TNFRSF10B (DR5) binding MRD
GSADPLWDCGDNPIKGRRQCVPL

SEQ ID NO: 4267 - protein, 23 aa, Artificial Sequence
  TNFRSF10B (DR5) binding MRD
GSLPHAWDCGDNPIPGRRQCVKL

SEQ ID NO: 4268 - protein, 23 aa, Artificial Sequence
  TNFRSF10B (DR5) binding MRD
GSTKLTHPCGEEDVIMTCRWRVA

SEQ ID NO: 4269 - protein, 23 aa, Artificial Sequence
  TNFRSF10B (DR5) binding MRD
GSTASPRHCAEHDVIMTCRWPVD

SEQ ID NO: 4270 - protein, 23 aa, Artificial Sequence
  TNFRSF10B (DR5) binding MRD
GSERLARSCDEDDVIMTCRWRVT

SEQ ID NO: 4271 - protein, 23 aa, Artificial Sequence
  TNFRSF10B (DR5) binding MRD
GSNKPPRPCSEEDVIMTCRWRVV

SEQ ID NO: 4272 - protein, 21 aa, Artificial Sequence
  TNFRSF10B (DR5) binding MRD
QGSDEWDCLDNRIGRRQCVKL

SEQ ID NO: 4273 - protein, 23 aa, Artificial Sequence
  TNFRSF10B (DR5) binding MRD
GSSLSSWDCGDNPIPGRRQCVKL

SEQ ID NO: 4274 - protein, 23 aa, Artificial Sequence
  TNFRSF10B (DR5) binding MRD
GSPSEYWDCGDNPIFGRRQCVRL

SEQ ID NO: 4275 - protein, 23 aa, Artificial Sequence
  TNFRSF10B (DR5) binding MRD
GSLSPLWDCGDNPILGRRQCVLL

SEQ ID NO: 4276 - protein, 23 aa, Artificial Sequence
  TNFRSF10B (DR5) binding MRD
GSAAHYWDCGDNPIVGRRQCVKL

SEQ ID NO: 4277 - protein, 23 aa, Artificial Sequence
  TNFRSF10B (DR5) binding MRD
GSYLYPRPCSEEDVIMTCRWRVS

SEQ ID NO: 4278 - protein, 23 aa, Artificial Sequence
  TNFRSF10B (DR5) binding MRD
GSSSFTPTCNEEDVIMTCRWRVV

SEQ ID NO: 4279 - protein, 23 aa, Artificial Sequence
  TNFRSF10B (DR5) binding MRD
GSLSAPPTCAEEDVIMTCRWRLK

SEQ ID NO: 4280 - protein, 23 aa, Artificial Sequence
  TNFRSF10B (DR5) binding MRD
GSRNFPVPCDESDVIMTCKWRVS

SEQ ID NO: 4281 - protein, 23 aa, Artificial Sequence
  TNFRSF10B (DR5) binding MRD
GSDRFQRHCSEADVIMTCKSRLY

SEQ ID NO: 4282 - protein, 21 aa, Artificial Sequence
  TNFRSF10B (DR5) binding MRD
QGSDEWDCLDNRIGKRQCVKL

SEQ ID NO: 4283 - protein, 23 aa, Artificial Sequence
  TNFRSF10B (DR5) binding MRD
GSSSFPRPCAEEDVIMTCKWRVY

SEQ ID NO: 4284 - protein, 23 aa, Artificial Sequence
  TNFRSF10B (DR5) binding MRD
GSMLLPRSCAEEDVIMTCRWAHY

SEQ ID NO: 4285 - protein, 19 aa, Artificial Sequence
  TNFRSF10B (DR5) binding MRD
GSGKCTEEDVIMTCRSKVT

SEQ ID NO: 4286 - protein, 23 aa, Artificial Sequence
  TNFRSF10B (DR5) binding MRD
GSSHFPHPCSEEDVIMTCRWRVN

SEQ ID NO: 4287 - protein, 23 aa, Artificial Sequence
  TNFRSF10B (DR5) binding MRD
GSVDFPRPCLEDDVIMTCKWRLY

SEQ ID NO: 4288 - protein, 23 aa, Artificial Sequence
  TNFRSF10B (DR5) binding MRD
GSVLDILSCKCLDTSSHVQCVTL

SEQ ID NO: 4289 - protein, 23 aa, Artificial Sequence
  TNFRSF10B (DR5) binding MRD
GSRMSSPSFDCKGDFGHRQCVKL

SEQ ID NO: 4290 - protein, 24 aa, Artificial Sequence
  TNFRSF10B (DR5) binding MRD
GSGEPSDGRVCLTKCSSLIQCFKF

SEQ ID NO: 4291 - protein, 24 aa, Artificial Sequence
  TNFRSF10B (DR5) binding MRD
GSHCLYVVWECVDHGICLRRCAEL

SEQ ID NO: 4292 - protein, 24 aa, Artificial Sequence
  TNFRSF10B (DR5) binding MRD
GSNNTTSMWDCLDRPIGQRQCVKL

SEQ ID NO: 4293 - protein, 24 aa, Artificial Sequence
  TNFRSF10B (DR5) binding MRD
GSYWSFSKWDCLDRPLGQRQCVLL

SEQ ID NO: 4294 - protein, 23 aa, Artificial Sequence
  TNFRSF10B (DR5) binding MRD
GSPTVPNQCHCQDNRISRMCVIL

SEQ ID NO: 4295 - protein, 24 aa, Artificial Sequence
  TNFRSF10B (DR5) binding MRD
GSDKFRERWDCLDYRIGHRQCIKL

SEQ ID NO: 4296 - protein, 24 aa, Artificial Sequence
  TNFRSF10B (DR5) binding MRD
GSMYTDDDRVCLTTCSVLRQCIKL

SEQ ID NO: 4297 - protein, 23 aa, Artificial Sequence
  TNFRSF10B (DR5) binding MRD
GSDLFSSRWDCLGKLGQRQCVKL

SEQ ID NO: 4298 - protein, 24 aa, Artificial Sequence
  TNFRSF10B (DR5) binding MRD
GSQLLTFGWDCLDRPIGQRQCVKI

SEQ ID NO: 4299 - protein, 24 aa, Artificial Sequence
  TNFRSF10B (DR5) binding MRD
GSGDEHAYWDCLDRPIGQRQCVKM

SEQ ID NO: 4300 - protein, 24 aa, Artificial Sequence
  TNFRSF10B (DR5) binding MRD
GSSGFYERWDCLDHHIGRRQCVKL

SEQ ID NO: 4301 - protein, 24 aa, Artificial Sequence
  TNFRSF10B (DR5) binding MRD
GSMKVTGPWDCLDRPIGQRQCVYL

SEQ ID NO: 4302 - protein, 24 aa, Artificial Sequence
  TNFRSF10B (DR5) binding MRD
GSLPDTYLTNCIHNRHDLCLCSKH

SEQ ID NO: 4303 - protein, 24 aa, Artificial Sequence
  TNFRSF10B (DR5) binding MRD
GSRSSSMPSVCLTDCISLRQCVKL

SEQ ID NO: 4304 - protein, 24 aa, Artificial Sequence
  TNFRSF10B (DR5) binding MRD
GSSNSMEPRVCLTNCTALRMCAKL

SEQ ID NO: 4305 - protein, 24 aa, Artificial Sequence
  TNFRSF10B (DR5) binding MRD
GSRIDLSQWDCLDYRLGQRQCVKV

SEQ ID NO: 4306 - protein, 23 aa, Artificial Sequence
  TNFRSF10B (DR5) binding MRD
GSIGHSPRWDCVGKPGHRQCVKL

SEQ ID NO: 4307 - protein, 24 aa, Artificial Sequence
  TNFRSF10B (DR5) binding MRD
GSQLLTSMFDCGDRPMGRRQCVLV

SEQ ID NO: 4308 - protein, 24 aa, Artificial Sequence
  TNFRSF10B (DR5) binding MRD
GSPHPTATRVCLTDCLSLRKCLKM

SEQ ID NO: 4309 - protein, 23 aa, Artificial Sequence
  TNFRSF10B (DR5) binding MRD
GSCTGVLTQACPAQNSFLQCVEL

SEQ ID NO: 4310 - protein, 23 aa, Artificial Sequence
  TNFRSF10B (DR5) binding MRD
GSSNFESRWDCIGNVGSRQCVKL

SEQ ID NO: 4311 - protein, 24 aa, Artificial Sequence
  TNFRSF10B (DR5) binding MRD
GSHNHYDDQVCLTQCNNLRLCIEL

SEQ ID NO: 4312 - protein, 24 aa, Artificial Sequence
  TNFRSF10B (DR5) binding MRD
GSQAPNIESLCLTRCVNLLHCIKI

SEQ ID NO: 4313 - protein, 16 aa, Artificial Sequence
  TNFRSF10B (DR5) binding MRD
WDCLDRPLGQRQCVLL

SEQ ID NO: 4314 - protein, 15 aa, Artificial Sequence
  TNFRSF10B (DR5) binding MRD
FDCKGDFGHRQCVKL

SEQ ID NO: 4315 - protein, 16 aa, Artificial Sequence
  TNFRSF10B (DR5) binding MRD
WDCLDRPIGQRQCVKM

SEQ ID NO: 4316 - protein, 16 aa, Artificial Sequence
  TNFRSF10B (DR5) binding MRD
WDCLDYRLGQRQCVKV

SEQ ID NO: 4317 - protein, 16 aa, Artificial Sequence
  TNFRSF10B (DR5) binding MRD
WDCLDRPIGQRQCVYL

SEQ ID NO: 4318 - protein, 15 aa, Artificial Sequence
  TNFRSF10B (DR5) binding MRD
WDCVGKPGHRQCVKL

SEQ ID NO: 4319 - protein, 16 aa, Artificial Sequence
  TNFRSF10B (DR5) binding MRD
WDCLDYRIGHRQCIKL

SEQ ID NO: 4320 - protein, 15 aa, Artificial Sequence
  TNFRSF10B (DR5) binding MRD
WDCIGNVGSRQCVKL

SEQ ID NO: 4321 - protein, 15 aa, Artificial Sequence
  DR5218
WDCLGKLGQRQCVKL

SEQ ID NO: 4322 - protein, 18 aa, Artificial Sequence
  DR53
FPRPCAEEDVIMTCRWRV

SEQ ID NO: 4323 - protein, 19 aa, Artificial Sequence
  CDA1
STLTCQVWLEDWYECIEVD

SEQ ID NO: 4324 - protein, 18 aa, Artificial Sequence
  CDA16
PNWVCWETPWTYECLEIE

SEQ ID NO: 4325 - protein, 18 aa, Artificial Sequence
  CDA26
VLLHCFGEPQWMECVPYV

SEQ ID NO: 4326 - protein, 18 aa, Artificial Sequence
  CDA33
FSPFCQYFQEFGECHYLS

SEQ ID NO: 4327 - protein, 20 aa, Artificial Sequence
  CDA48
LLLRCMYEPYYWELQCVEVE

SEQ ID NO: 4328 - protein, 20 aa, Artificial Sequence
  CDA53
YIYTCSFIWDYQEIYCSPEL

SEQ ID NO: 4329 - protein, 19 aa, Artificial Sequence
  CD3 binding MRD
FDLLCVHVESHKYYCFRPI

SEQ ID NO: 4330 - protein, 18 aa, Artificial Sequence
  CD3 binding MRD
FILSCHWHNGVVRCYEVS

SEQ ID NO: 4331 - protein, 20 aa, Artificial Sequence
  CD3 binding MRD
PPFSCVFDVPIWSWVCGQKS

SEQ ID NO: 4332 - protein, 19 aa, Artificial Sequence
  CD3 binding MRD
AQLLCHHVTGKYFSCREVI

SEQ ID NO: 4333 - protein, 18 aa, Artificial Sequence
  CD3 binding MRD
DWWLCESEKQTFWCSILR

SEQ ID NO: 4334 - protein, 20 aa, Artificial Sequence
  CD3 binding MRD
RGMQCHFEKTGWMWVCSLAG

SEQ ID NO: 4335 - protein, 18 aa, Artificial Sequence
  CD3 binding MRD
FMMQCQYVMNGIYCYDSG

SEQ ID NO: 4336 - protein, 41 aa, Artificial Sequence
  CD3 binding MRD
FRLGCVPLPVIQACVAQAAAGGSKIWECEQNPQVWICNLTS

SEQ ID NO: 4337 - protein, 19 aa, Artificial Sequence
  CD3 binding MRD
PKLLCHDTEDIYCFCELLK

SEQ ID NO: 4338 - protein, 20 aa, Artificial Sequence
  CD3 binding MRD
LFGRCYLYHNLAWYHCVLVW

SEQ ID NO: 4339 - protein, 18 aa, Artificial Sequence
  CD3 binding MRD
IGLLCKKDHGEWSCFRIY

SEQ ID NO: 4340 - protein, 18 aa, Artificial Sequence
  CD3 binding MRD
FMVDCQKMPHYIICAERG

SEQ ID NO: 4341 - protein, 19 aa, Artificial Sequence
  CD3 binding MRD
EWQCAYYPQYFQWQCEILG

SEQ ID NO: 4342 - protein, 20 aa, Artificial Sequence
  CD3 binding MRD
GPPWCMWHQRQYSWICIFGE

SEQ ID NO: 4343 - protein, 20 aa, Artificial Sequence
  CD3 binding MRD
IAWDCQWHHQWHAWECTMNS

SEQ ID NO: 4344 - protein, 16 aa, Artificial Sequence
  CD3 binding MRD
WDAVLCVNKRCSGLYF

SEQ ID NO: 4345 - protein, 19 aa, Artificial Sequence
  CD3 binding MRD
TVVRCYQSPYVYWICKFPT

SEQ ID NO: 4346 - protein, 18 aa, Artificial Sequence
  CD3 binding MRD
FSVICWQKPDYLYCAEDA

SEQ ID NO: 4347 - protein, 20 aa, Artificial Sequence
  CD3 binding MRD
RTVYCGWDANRQAWLCHCQN

SEQ ID NO: 4348 - protein, 20 aa, Artificial Sequence
  CD3 binding MRD
PGFRCSWWEIAKSWVCTMPV

SEQ ID NO: 4349 - protein, 20 aa, Artificial Sequence
  CD3 binding MRD
DLLDCSFNEFEWHWTCSFTQ

SEQ ID NO: 4350 - protein, 20 aa, Artificial Sequence
  CD3 binding MRD
PLVSCQYFPPLHHWRCDFLV

SEQ ID NO: 4351 - protein, 17 aa, Artificial Sequence
  CD3 binding MRD
DKWKCRWKEAYICMRDS

SEQ ID NO: 4352 - protein, 19 aa, Artificial Sequence
  CD3 binding MRD
YRLSCQYLSAHQVICSGLW

SEQ ID NO: 4353 - protein, 18 aa, Artificial Sequence
  CD3 binding MRD
RWAYCSVQDIMWDCTLFP

SEQ ID NO: 4354 - protein, 20 aa, Artificial Sequence
  CD3 binding MRD
TMITCHWRKDHYDWMCQLEY

SEQ ID NO: 4355 - protein, 18 aa, Artificial Sequence
  CD3 binding MRD
FILSCHWNLGVVPCYEVS

SEQ ID NO: 4356 - protein, 18 aa, Artificial Sequence
  CD3 binding MRD
PVMSCEPIPIGWKCSLQT

SEQ ID NO: 4357 - protein, 18 aa, Artificial Sequence
  CD3 binding MRD
FSPECHYFPGYWKCTWSL

SEQ ID NO: 4358 - protein, 19 aa, Artificial Sequence
  CD3 binding MRD
WPQRCVWWWEMDYKCRSLI

SEQ ID NO: 4359 - protein, 18 aa, Artificial Sequence
  CD3 binding MRD
TYWDCVVGHKHMQCLRLS

SEQ ID NO: 4360 - protein, 20 aa, Artificial Sequence
  CD3 binding MRD
SRGWCQYEYQHSQWRCFIHE

SEQ ID NO: 4361 - protein, 20 aa, Artificial Sequence
  CD3 binding MRD
RLVSCSWENSKWQWTCSVLE

SEQ ID NO: 4362 - protein, 19 aa, Artificial Sequence
  CD3 binding MRD
PDSSCHTLYWQLHHCARRE

SEQ ID NO: 4363 - protein, 20 aa, Artificial Sequence
  CD3 binding MRD
GQVTCNYNPATHSWVCSCIS

SEQ ID NO: 4364 - protein, 20 aa, Artificial Sequence
  CD3 binding MRD
TVFRCVFVNEYRVWFCHIST

SEQ ID NO: 4365 - protein, 19 aa, Artificial Sequence
  CD3 binding MRD
GEEVCYWAPFEPVRCLPVW

SEQ ID NO: 4366 - protein, 18 aa, Artificial Sequence
  CD3 binding MRD
VFMVCVHHYEKVKCWAFW

SEQ ID NO: 4367 - protein, 19 aa, Artificial Sequence
  CD3 binding MRD
FFALCKFQNFHTATCLKLI

SEQ ID NO: 4368 - protein, 19 aa, Artificial Sequence
  CD3 binding MRD
WSFLCIKVTQQHYECFLFS

SEQ ID NO: 4369 - protein, 18 aa, Artificial Sequence
  CD3 binding MRD
GLVSCVILPQGWFCFKTA

SEQ ID NO: 4370 - protein, 16 aa, Artificial Sequence
  CD3 binding MRD
QVKYCVVTHMMCVIDL

SEQ ID NO: 4371 - protein, 19 aa, Artificial Sequence
  CD3 binding MRD
RSALCHDKMTVKSYCLSSR

SEQ ID NO: 4372 - protein, 16 aa, Artificial Sequence
  CD3 binding MRD
IFFVCPNNQYDCAVNH

SEQ ID NO: 4373 - protein, 18 aa, Artificial Sequence
  CD3 binding MRD
WNFFCITFGPYLHCWIYT

SEQ ID NO: 4374 - protein, 19 aa, Artificial Sequence
  CD3 binding MRD
TMEVCYWGPFTTATCERWP

SEQ ID NO: 4375 - protein, 18 aa, Artificial Sequence
  CD3 binding MRD
WECYCQGHVHYIYCVCFR

SEQ ID NO: 4376 - protein, 18 aa, Artificial Sequence
  CD3 binding MRD
NHWFCFTDWHHFVCFKFA

SEQ ID NO: 4377 - protein, 18 aa, Artificial Sequence
  CD3 binding MRD
CWVSCWIWPNMWYCWLDC

SEQ ID NO: 4378 - protein, 22 aa, Artificial Sequence
  CD3 binding MRD
GVGGLLLGSVRTGSLPPGVGPG

SEQ ID NO: 4379 - protein, 19 aa, Artificial Sequence
  CD3 binding MRD
YAAWCFKLNKLEVICFSGI

SEQ ID NO: 4380 - protein, 19 aa, Artificial Sequence
  CD3 binding MRD
ARFVCFSLVEAQWYCLVLS

SEQ ID NO: 4381 - protein, 18 aa, Artificial Sequence
  CD3 binding MRD
IYFTCVWYAQQFWCIVMP

SEQ ID NO: 4382 - protein, 18 aa, Artificial Sequence
  CD3 binding MRD
RGWVCYFFPPHFVCYTWV

SEQ ID NO: 4383 - protein, 18 aa, Artificial Sequence
  CD3 binding MRD
FSLVCIQMYNQVYCVFIL

SEQ ID NO: 4384 - protein, 19 aa, Artificial Sequence
  CD3 binding MRD
QDFLCVKIEPFPWICWTMQ

SEQ ID NO: 4385 - protein, 18 aa, Artificial Sequence
  CD3 binding MRD
FTCVCYQHYDHFWCGCLW

SEQ ID NO: 4386 - protein, 18 aa, Artificial Sequence
  CD3 binding MRD
ILWACVKQYDGMICWSPS

SEQ ID NO: 4387 - protein, 18 aa, Artificial Sequence
  CD3 binding MRD
FWLLCIHAPKQDVCFIWM

SEQ ID NO: 4388 - protein, 18 aa, Artificial Sequence
  CD3 binding MRD
FRALCWEHPPTRYCILFT

SEQ ID NO: 4389 - protein, 18 aa, Artificial Sequence
  CD3 binding MRD
TAWWCVIMPPKFFCASFN

SEQ ID NO: 4390 - protein, 19 aa, Artificial Sequence
  CD3 binding MRD
GRVSCYWETHLNVVCVPSL

SEQ ID NO: 4391 - protein, 19 aa, Artificial Sequence
  CD3 binding MRD
IKLECKVHAPSMLSCTLWQ

SEQ ID NO: 4392 - protein, 18 aa, Artificial Sequence
  CD3 binding MRD
YEWSCLITPYGHWCAQTV

SEQ ID NO: 4393 - protein, 19 aa, Artificial Sequence
  CD3 binding MRD
FTLLCIKFELKPYICWVSL

SEQ ID NO: 4394 - protein, 19 aa, Artificial Sequence
  CD3 binding MRD
TPRGCTFIFIMPDMCRPSL

SEQ ID NO: 4395 - protein, 18 aa, Artificial Sequence
  CD3 binding MRD
LRCTCWIFPKNVYCLCLS

SEQ ID NO: 4396 - protein, 16 aa, Artificial Sequence
  CD3 binding MRD
AFLLRCYAQECVILWL

SEQ ID NO: 4397 - protein, 18 aa, Artificial Sequence
  CD3 binding MRD
GMVSCVIMPQGWFCFKTA

SEQ ID NO: 4398 - protein, 18 aa, Artificial Sequence
  CD3 binding MRD
MHWVCIIFPPGFFCVSTF

SEQ ID NO: 4399 - protein, 19 aa, Artificial Sequence
  CD3 binding MRD
LHFRCFQLYNEYWVCIMSV

SEQ ID NO: 4400 - protein, 20 aa, Artificial Sequence
  CD3 binding MRD
WNFLCFFTHHKPVWYCVWTM

SEQ ID NO: 4401 - protein, 16 aa, Artificial Sequence
  CD3 binding MRD
GFQCWCPHVVCFRVPY

SEQ ID NO: 4402 - protein, 19 aa, Artificial Sequence
  CD3 binding MRD
MQFLCLTVQTNTWYCFLWL

SEQ ID NO: 4403 - protein, 17 aa, Artificial Sequence
  CD3 binding MRD
FIVRCVIGQKLVCVQTE

SEQ ID NO: 4404 - protein, 20 aa, Artificial Sequence
  CD3 binding MRD
WSPNCLWFIKTTYVVCPDST

SEQ ID NO: 4405 - protein, 19 aa, Artificial Sequence
  CD3 binding MRD
YAWECQWIVKPHQFVCGGM

SEQ ID NO: 4406 - protein, 18 aa, Artificial Sequence
  CD3 binding MRD
GTLRCYSLNWGYFCILFV

SEQ ID NO: 4407 - protein, 20 aa, Artificial Sequence
  CD3 binding MRD
NKVECHIVLWTFHFGCPSAT

SEQ ID NO: 4408 - protein, 18 aa, Artificial Sequence
  CD3 binding MRD
TSMVCRSMHMYWLCVNLD

SEQ ID NO: 4409 - protein, 20 aa, Artificial Sequence
  CD3 binding MRD
NRVLCMMNYIHVTKLCDRPM

SEQ ID NO: 4410 - protein, 19 aa, Artificial Sequence
  CD3 binding MRD
PLMLCRHMKHFQYYCWPLA

SEQ ID NO: 4411 - protein, 19 aa, Artificial Sequence
  CD3 binding MRD
PSQRCVNHFVIFFNCTQSN

SEQ ID NO: 4412 - protein, 20 aa, Artificial Sequence
  CD3 binding MRD
WNFFCITFSPTCIVDLYWPG

SEQ ID NO: 4413 - protein, 19 aa, Artificial Sequence
  CD3 binding MRD
WTMRCYSHAPNKLVCSVGL

SEQ ID NO: 4414 - protein, 18 aa, Artificial Sequence
  CD3 binding MRD
LVLHCDYQQGVWTCKAVL

SEQ ID NO: 4415 - protein, 18 aa, Artificial Sequence
  CD3 binding MRD
VMFVCFSLPEQQVCVPLS

SEQ ID NO: 4416 - protein, 17 aa, Artificial Sequence
  CD3 binding MRD
PVQICQWTLELQCSPWT

SEQ ID NO: 4417 - protein, 15 aa, Artificial Sequence
  CD3 binding MRD
LQWVCHWVAECSMSP

SEQ ID NO: 4418 - protein, 17 aa, Artificial Sequence
  CD3 binding MRD
RGFICEWNLVASCVPAT

SEQ ID NO: 4419 - protein, 15 aa, Artificial Sequence
  CD3 binding MRD
RIWICDWTIECVESL

SEQ ID NO: 4420 - protein, 20 aa, Artificial Sequence
  CD3 binding MRD
FVCECFAWDWFGPWQCMCSV

SEQ ID NO: 4421 - protein, 46 aa, Artificial Sequence
  CD3 binding MRD
RFWIECWTEACRPGLLGQAGQGGPGSAGGSYPSIECYSYMCNVLWF

SEQ ID NO: 4422 - protein, 37 aa, Artificial Sequence
  CD3 binding MRD
LRSSCEYHQTCNQSSQAAAGGSREMKCDWRVDCLYYV

SEQ ID NO: 4423 - protein, 17 aa, Artificial Sequence
  CD3 binding MRD
TLTVCQWVLHATCVDVQ

SEQ ID NO: 4424 - protein, 15 aa, Artificial Sequence
  CD3 binding MRD
VSIRCHQYLLCVFES

SEQ ID NO: 4425 - protein, 15 aa, Artificial Sequence
  CD3 binding MRD
SAWFCEWTFQCQLMG

SEQ ID NO: 4426 - protein, 15 aa, Artificial Sequence
  CD3 binding MRD
GFIVCYWEAVCQSST

SEQ ID NO: 4427 - protein, 15 aa, Artificial Sequence
  CD3 binding MRD
VLWRCTWVMECVSVS

SEQ ID NO: 4428 - protein, 15 aa, Artificial Sequence
  CD3 binding MRD
DMWLCHWRIECVPYL

SEQ ID NO: 4429 - protein, 18 aa, Artificial Sequence
  CD3 binding MRD
PWASCYFYQEHVHCLPPD

SEQ ID NO: 4430 - protein, 17 aa, Artificial Sequence
  CD3 binding MRD
SYSVCEWEFVYSCWPPY

SEQ ID NO: 4431 - protein, 15 aa, Artificial Sequence
  CD3 binding MRD
RQQPCLKIWSCLQLY

SEQ ID NO: 4432 - protein, 17 aa, Artificial Sequence
  CD3 binding MRD
PVQICQWTLELPCSPWT

SEQ ID NO: 4433 - protein, 20 aa, Artificial Sequence
  CD3 binding MRD
PVPICPWTLELHCPPWTGHA

SEQ ID NO: 4434 - protein, 15 aa, Artificial Sequence
  CD3 binding MRD
MACLCVSWSKCTPLG

SEQ ID NO: 4435 - protein, 16 aa, Artificial Sequence
  CD3 binding MRD
QTMKCPMEMGHCTTWR

SEQ ID NO: 4436 - protein, 15 aa, Artificial Sequence
  CD3 binding MRD
FILLCHQYLVCIKQE

SEQ ID NO: 4437 - protein, 16 aa, Artificial Sequence
  CD3 binding MRD
FYMRDCLSHRCRLDLS

SEQ ID NO: 4438 - protein, 16 aa, Artificial Sequence
  CD3 binding MRD
GFQLACRFMSCGCRSC

SEQ ID NO: 4439 - protein, 18 aa, Artificial Sequence
  CD3 binding MRD
PLMLCRHMKHFEYYCWPL

SEQ ID NO: 4440 - protein, 21 aa, Artificial Sequence
  CD3 binding MRD
QDFLCVKIEPFPWICWTMQGQ

SEQ ID NO: 4441 - protein, 18 aa, Artificial Sequence
  CD3 binding MRD
IYFYCVEWYQKWICYTVV

SEQ ID NO: 4442 - protein, 17 aa, Artificial Sequence
  CD3 binding MRD
VTCFYVETDHVVCFREA

SEQ ID NO: 4443 - protein, 19 aa, Artificial Sequence
  CD3 binding MRD
GRVSCYWETHLNVVCVPSL

SEQ ID NO: 4444 - protein, 20 aa, Artificial Sequence
  CD3 binding MRD
FPCVCIMTHHHLECFCFIGQ

SEQ ID NO: 4445 - protein, 20 aa, Artificial Sequence
  CD3 binding MRD
FSLVCIQMYNQVYCVFILGQ

SEQ ID NO: 4446 - protein, 20 aa, Artificial Sequence
  CD3 binding MRD
ILWACVKQYDGMICWSPSGQ

SEQ ID NO: 4447 - protein, 19 aa, Artificial Sequence
  CD3 binding MRD
VKLPCFLIQEMGWMCFWPL

SEQ ID NO: 4448 - protein, 20 aa, Artificial Sequence
  CD3 binding MRD
WNFFCINFSPYLHCWIYTGQ

SEQ ID NO: 4449 - protein, 20 aa, Artificial Sequence
  CD3 binding MRD
MYVLCKEAQVGQQWKCVQFF

SEQ ID NO: 4450 - protein, 20 aa, Artificial Sequence
  CD3 binding MRD
YTPECGWGYMIMFKHCRHYE

SEQ ID NO: 4451 - protein, 20 aa, Artificial Sequence
  CD3 binding MRD
FWLLCLHVWNKTTVYCLVKH

SEQ ID NO: 4452 - protein, 19 aa, Artificial Sequence
  CD3 binding MRD
FQCVCVHWNDGRVVCLCHY

SEQ ID NO: 4453 - protein, 17 aa, Artificial Sequence
  CD3 binding MRD
DYTSCQFRGWLICEAMA

SEQ ID NO: 4454 - protein, 18 aa, Artificial Sequence
  CD3 binding MRD
LVMLCWKWHEVRHCLLLS

SEQ ID NO: 4455 - protein, 20 aa, Artificial Sequence
  CD3 binding MRD
VVLTCSSSWERSVFVCRLVE

SEQ ID NO: 4456 - protein, 18 aa, Artificial Sequence
  CD3 binding MRD
LAFLCIHWQEHLWCIVRP

SEQ ID NO: 4457 - protein, 19 aa, Artificial Sequence
  CD3 binding MRD
SVVTCYHMFPWDRIICFLQ

SEQ ID NO: 4458 - protein, 16 aa, Artificial Sequence
  CD3 binding MRD
TVRCWCEHMVCFMERD

SEQ ID NO: 4459 - protein, 20 aa, Artificial Sequence
  CD3 binding MRD
CHFLCFKLGFMEYFYCEYSC

SEQ ID NO: 4460 - protein, 20 aa, Artificial Sequence
  CD3 binding MRD
VMLACYKHPLNNSEWCYILP

SEQ ID NO: 4461 - protein, 18 aa, Artificial Sequence
  CD3 binding MRD
FRVLCADVPGHRYCFIVS

SEQ ID NO: 4462 - protein, 18 aa, Artificial Sequence
  CD3 binding MRD
LVFRCLHITQHWFCFGLT

SEQ ID NO: 4463 - protein, 17 aa, Artificial Sequence
  CD3 binding MRD
EYDSCMFYGFIICPKQT

SEQ ID NO: 4464 - protein, 16 aa, Artificial Sequence
  CD3 binding MRD
MLFVRCEHGRCTVYEI

SEQ ID NO: 4465 - protein, 20 aa, Artificial Sequence
  CD3 binding MRD
CEIFCMVSLETQKMVCVHRA

SEQ ID NO: 4466 - protein, 20 aa, Artificial Sequence
  CD3 binding MRD
MGFLCWSQPGNEYEWCVPIN

SEQ ID NO: 4467 - protein, 20 aa, Artificial Sequence
  CD3 binding MRD
RFIHCVHFEWINHIVCFVGT

SEQ ID NO: 4468 - protein, 19 aa, Artificial Sequence
  CD3 binding MRD
QDFLCVKIEPFPWICWTMQ

SEQ ID NO: 4469 - protein, 20 aa, Artificial Sequence
  CD3 binding MRD
DRALCWLHPHFATVQCIIMS

SEQ ID NO: 4470 - protein, 17 aa, Artificial Sequence
  CD3 binding MRD
VTCFYVETDHVVCFREA

SEQ ID NO: 4471 - protein, 19 aa, Artificial Sequence
  CD3 binding MRD
GRVSCYWETHLNVVCVPSL

SEQ ID NO: 4472 - protein, 18 aa, Artificial Sequence
  CD3 binding MRD
FPCVCIMTHHHLECFCFI

SEQ ID NO: 4473 - protein, 18 aa, Artificial Sequence
  CD3 binding MRD
FSLVCIQMYNQVYCVFIL

SEQ ID NO: 4474 - protein, 18 aa, Artificial Sequence
  CD3 binding MRD
ILWACVKQYDGMICWSPS

SEQ ID NO: 4475 - protein, 19 aa, Artificial Sequence
  CD3 binding MRD
ADSWCHTLYWNLRHCEIQE

SEQ ID NO: 4476 - protein, 18 aa, Artificial Sequence
  CD3 binding MRD
WNFFCINFSPYLHCWIYT

SEQ ID NO: 4477 - protein, 19 aa, Artificial Sequence
  CD3 binding MRD
ESLDCATPLLLCTGCGDQA

SEQ ID NO: 4478 - protein, 16 aa, Artificial Sequence
  CD3 binding MRD
SFQMCMGWFWWCWSHS

SEQ ID NO: 4479 - protein, 16 aa, Artificial Sequence
  CD3 binding MRD
WSQSGCTYAHCMYCIH

SEQ ID NO: 4480 - protein, 18 aa, Artificial Sequence
  CD3 binding MRD
VNCWLHLQFFYSEQYCIE

SEQ ID NO: 4481 - protein, 20 aa, Artificial Sequence
  CD3 binding MRD
ATGGSLVVKCDWWLDCLVYL

SEQ ID NO: 4482 - protein, 17 aa, Artificial Sequence
  CD3 binding MRD
DLQICHWTLELECSPRK

SEQ ID NO: 4483 - protein, 20 aa, Artificial Sequence
  CD3 binding MRD
ATGGSREIRCKWRVDCMCYS

SEQ ID NO: 4484 - protein, 41 aa, Artificial Sequence
  CD3 binding MRD
SLSSCELYYKCRHFSQAGQGSATGGSLVVKCDWWLDCLVYL

SEQ ID NO: 4485 - protein, 41 aa, Artificial Sequence
  CD3 binding MRD
LRCFCDYYQTCKQYTVAGQGSATGGSREIRCKWRVDCMCYS

SEQ ID NO: 4486 - protein, 18 aa, Artificial Sequence
  CD3 binding MRD
WNYFCVYFSPYLHCWIYS

SEQ ID NO: 4487 - protein, 18 aa, Artificial Sequence
  CD3 binding MRD
WNFVCIFVSPYMHCWLYF

SEQ ID NO: 4488 - protein, 18 aa, Artificial Sequence
  CD3 binding MRD
WKFLCINLSPYLHCWIYP

SEQ ID NO: 4489 - protein, 18 aa, Artificial Sequence
  CD3 binding MRD
WNFFCIYISPHVHCWIHS

SEQ ID NO: 4490 - protein, 18 aa, Artificial Sequence
  CD3 binding MRD
IAWDCVVGQKYMLCQRLS

SEQ ID NO: 4491 - protein, 20 aa, Artificial Sequence
  CD3 binding MRD
CQERCGKMIKSIVMQCNLRL

SEQ ID NO: 4492 - protein, 19 aa, Artificial Sequence
  CD3 binding MRD
SVSVCVEHAYGQWYCFAAR

SEQ ID NO: 4493 - protein, 15 aa, Artificial Sequence
  CD3 binding MRD
TMKCPMEMGHCTTWR

SEQ ID NO: 4494 - protein, 19 aa, Artificial Sequence
  CD31916
IALMCSMHFDEVVWCSPYY

SEQ ID NO: 4495 - protein, 19 aa, Artificial Sequence
  CD3437
PLMLCRHMKHFEYYCWPLA

SEQ ID NO: 4496 - protein, 16 aa, Artificial Sequence
  CD3914
PVICQWTLELQCSPWT

SEQ ID NO: 4497 - protein, 18 aa, Artificial Sequence
  CD3434
ILLECYWEDWRLVCSSLA

SEQ ID NO: 4498 - protein, 17 aa, Artificial Sequence
  CD3702
KGTICWWHLEATCFATS

SEQ ID NO: 4499 - protein, 18 aa, Artificial Sequence
  CD31913
LREICVKVPYGVVCQRLP

SEQ ID NO: 4500 - protein, 18 aa, Artificial Sequence
  NKG1
FSLFCYNVHGWWECFPVY

SEQ ID NO: 4501 - protein, 20 aa, Artificial Sequence
  NKG4
SLTWCMVEKLHYWVICDRVA

SEQ ID NO: 4502 - protein, 18 aa, Artificial Sequence
  NKG7
ILISCQEQWPVFQCYAVR

SEQ ID NO: 4503 - protein, 17 aa, Artificial Sequence
  NKG9
HEEDCYWILYQHCPRAT

SEQ ID NO: 4504 - protein, 18 aa, Artificial Sequence
  NKG12
LEHLCTTYPMWFHCPEGA

SEQ ID NO: 4505 - protein, 18 aa, Artificial Sequence
  NKG14
SGLVCFSRFDWWECVWTS

SEQ ID NO: 4506 - protein, 20 aa, Artificial Sequence
  NKG15
SLTRSRYQRFHYWVICDRVA

SEQ ID NO: 4507 - protein, 19 aa, Artificial Sequence
  NKG17
YTVACYYGVDQYWMCFSNS

SEQ ID NO: 4508 - protein, 19 aa, Artificial Sequence
  MRD and/or a multivalent and monovalent multispecific composition that binds CD319 linker
WRLDCWEHHEWDFWCWAHG

SEQ ID NO: 4509 - protein, 19 aa, Artificial Sequence
  MRD and/or a multivalent and monovalent multispecific composition that binds CD319 linker
SLYECWRVFVSFPRCPDGS

SEQ ID NO: 4510 - protein, 19 aa, Artificial Sequence
  MRD and/or a multivalent and monovalent multispecific composition that binds CD319 linker
LYLLCEHVHDKHWECGSWL

SEQ ID NO: 4511 - protein, 19 aa, Artificial Sequence
  MRD and/or a multivalent and monovalent multispecific composition that binds CD319 linker
IHLRCTYVEPLYMLCSPYA

SEQ ID NO: 4512 - protein, 16 aa, Artificial Sequence
  MRD and/or a multivalent and monovalent multispecific composition that binds CD319 linker
TMMVECYMGYCYPTVF

SEQ ID NO: 4513 - protein, 19 aa, Artificial Sequence
  MRD and/or a multivalent and monovalent multispecific composition that binds CD319 linker
VLLRCQYVGVSHIKCKSVD

SEQ ID NO: 4514 - protein, 19 aa, Artificial Sequence
  MRD and/or a multivalent and monovalent multispecific composition that binds CD319 linker
LVLECFLIDAWYMKCHTTG

SEQ ID NO: 4515 - protein, 19 aa, Artificial Sequence
  MRD and/or a multivalent and monovalent multispecific composition that binds CD319 linker
LRLYCIPVDHTFFKCTLYG

SEQ ID NO: 4516 - protein, 16 aa, Artificial Sequence
  MRD and/or a multivalent and monovalent multispecific composition that binds CD319 linker
YCIYRCQVQQCWMFPA

SEQ ID NO: 4517 - protein, 20 aa, Artificial Sequence
  MRD and/or a multivalent and monovalent multispecific composition that binds CD319 linker
WHIACWEMRDVHWYVCEFFV

SEQ ID NO: 4518 - protein, 19 aa, Artificial Sequence
  MRD and/or a multivalent and monovalent multispecific composition that binds CD319 linker
RVLQCKWVSSEYFQCVETS

SEQ ID NO: 4519 - protein, 19 aa, Artificial Sequence
  MRD and/or a multivalent and monovalent multispecific composition that binds CD319 linker
VVVECFQVKEMYWSCRPAV

SEQ ID NO: 4520 - protein, 19 aa, Artificial Sequence
  MRD and/or a multivalent and monovalent multispecific composition that binds CD319 linker
YLMYCTALEYPYFQCRQMV

What is claimed is:

1. A modular recognition domain (MRD) capable of binding an epidermal growth factor receptor (EGFR), wherein the MRD comprises the amino acid sequence YAEHCRQFPSDWICTLLP (SEQ ID NO: 3109).

2. A complex comprising the MRD of claim 1, wherein the MRD is fused to a heterologous protein.

3. The complex of claim 2, wherein the heterologous protein is an antibody.

4. The complex of claim 3, wherein the MRD and the antibody bind different targets.

5. The complex of claim 3, wherein the MRD and the antibody are operably linked by a linker.

6. The complex of claim 5, wherein the antibody binds EGFR.

7. The complex of claim 6, which further comprises an additional covalently bound MRD, wherein the additional covalently bound MRD binds Erb-B2 Receptor Tyrosine Kinase 3 (ErbB3) and comprises an amino acid sequence selected from the group consisting of SEQ ID NO:3499-4094.

8. A pharmaceutical composition comprising the complex of claim 6.

9. The complex of claim 6, wherein the antibody is cetuximab.

10. The complex of claim 9, which further comprises an additional covalently bound MRD, wherein the additional covalently bound MRD binds ErbB3 and comprises an amino acid sequence selected from the group consisting of SEQ ID NO:3499-4094.

11. A pharmaceutical composition comprising the complex of claim 9.

12. A complex comprising an antibody and an MRD, wherein the antibody is cetuximab and the MRD comprises the amino acid sequence

YAEHCRQFPSDWICTLLP (SEQ ID NO: 3109).

13. A pharmaceutical composition comprising the complex of claim 12.

* * * * *